US007759548B2

(12) United States Patent
Metz et al.

(10) Patent No.: US 7,759,548 B2
(45) Date of Patent: Jul. 20, 2010

(54) POLYUNSATURATED FATTY ACID PRODUCTION IN HETEROLOGOUS ORGANISMS USING PUFA POLYKETIDE SYNTHASE SYSTEMS

(75) Inventors: James G. Metz, Longmont, CO (US); Jerry M. Kuner, Longmont, CO (US); James Casey Lippmeier, Columbia, MD (US)

(73) Assignee: Martek Biosciences Corporation, Columbia, MD (US)

( * ) Notice: Subject to any disclaimer, the term of this patent is extended or adjusted under 35 U.S.C. 154(b) by 111 days.

(21) Appl. No.: 11/686,856

(22) Filed: Mar. 15, 2007

(65) Prior Publication Data
US 2007/0270494 A1  Nov. 22, 2007

Related U.S. Application Data

(60) Provisional application No. 60/784,616, filed on Mar. 21, 2006, provisional application No. 60/783,205, filed on Mar. 15, 2006.

(51) Int. Cl.
*A01H 5/00* (2006.01)
*C12N 15/82* (2006.01)
*C07H 21/04* (2006.01)
*C12N 1/20* (2006.01)
*C12N 5/10* (2006.01)

(52) U.S. Cl. ............ 800/298; 800/281; 536/23.2; 435/468; 435/471; 435/419; 435/252.3

(58) Field of Classification Search ............ None
See application file for complete search history.

(56) References Cited

U.S. PATENT DOCUMENTS

| | | | |
|---|---|---|---|
| 5,130,242 A | 7/1992 | Barclay et al. |
| 5,246,841 A | 9/1993 | Yazawa et al. |
| 5,310,242 A | 5/1994 | Golder |
| 5,639,790 A | 6/1997 | Voelker et al. |
| 5,672,491 A | 9/1997 | Khosla et al. |
| 5,683,898 A | 11/1997 | Yazawa et al. |
| 5,798,259 A | 8/1998 | Yazawa et al. |
| 5,908,622 A | 6/1999 | Barclay |
| 6,033,883 A | 3/2000 | Barr et al. |
| 6,140,486 A | 10/2000 | Facciotti et al. |
| 6,503,706 B1 | 1/2003 | Abken et al. |
| 6,566,583 B1 | 5/2003 | Facciotti et al. |
| 6,677,145 B2 | 1/2004 | Mukerji et al. |
| 7,001,772 B2 | 2/2006 | Roessler et al. |
| 7,087,432 B2 | 8/2006 | Qiu et al. |
| 7,125,672 B2 | 10/2006 | Picataggio et al. |
| 7,208,590 B2 | 4/2007 | Mukerji et al. |
| 7,211,418 B2 | 5/2007 | Metz et al |
| 7,214,853 B2 | 5/2007 | Facciotti et al. |
| 7,217,856 B2 | 5/2007 | Weaver et al. |
| 7,247,461 B2 | 7/2007 | Metz et al. |
| 7,256,022 B2 | 8/2007 | Metz et al. |
| 7,256,023 B2 | 8/2007 | Metz et al. |
| 7,259,295 B2 | 8/2007 | Metz et al. |
| 7,271,315 B2 | 9/2007 | Metz et al. |
| 2004/0005672 A1 | 1/2004 | Santi et al. |
| 2004/0010817 A1 | 1/2004 | Shockey et al. |
| 2004/0139498 A1 | 7/2004 | Jaworski et al. |
| 2004/0172682 A1 | 9/2004 | Kinney et al. |
| 2005/0089865 A1 | 4/2005 | Napier et al. |
| 2005/0164192 A1 | 7/2005 | Graham et al. |
| 2007/0244192 A1 | 10/2007 | Metz |
| 2007/0245431 A1 | 10/2007 | Metz et al. |
| 2007/0256146 A1 | 11/2007 | Metz et al. |
| 2007/0266455 A1 | 11/2007 | Weaver et al. |
| 2008/0022422 A1 | 1/2008 | Weaver et al. |
| 2008/0026434 A1 | 1/2008 | Weaver et al. |
| 2008/0026435 A1 | 1/2008 | Weaver et al. |
| 2008/0026436 A1 | 1/2008 | Weaver et al. |

(Continued)

FOREIGN PATENT DOCUMENTS

CA     2520795     10/2004

(Continued)

OTHER PUBLICATIONS

Van de Loo et al, PNAS, USA 92: 6743-6747, Jul. 1995.*

(Continued)

*Primary Examiner*—Elizabeth F McElwain
(74) *Attorney, Agent, or Firm*—Sterne, Kessler, Goldstein & Fox P.L.L.C.

(57) ABSTRACT

Disclosed are novel acyl-CoA synthetases and novel acyltransferases, nucleic acid molecules encoding the same, recombinant nucleic acid molecules and recombinant host cells comprising such nucleic acid molecules, genetically modified organisms (microorganisms and plants) comprising the same, and methods of making and using the same. Also disclosed are genetically modified organisms (e.g., plants, microorganisms) that have been genetically modified to express a PKS-like system for the production of PUFAs (a PUFA PKS system or PUFA synthase), wherein the organisms have been modified to express an acyl-CoA synthetase, to express an acyl transferase, to delete or inactivate a fatty acid synthase (FAS) expressed by the organism, to reduce competition for malonyl CoA with the PUFA synthase or to increase the level of malonyl CoA in the organism, and in one aspect, to inhibit KASII or KASIII. Additional modifications, and methods to make and use such organisms, in addition to PUFAs and oils obtained from such organisms, are disclosed, alone with various products including such PUFAs and oils.

21 Claims, 15 Drawing Sheets

U.S. PATENT DOCUMENTS

| | | |
|---|---|---|
| 2008/0026437 A1 | 1/2008 | Weaver et al. |
| 2008/0026438 A1 | 1/2008 | Metz et al. |
| 2008/0026439 A1 | 1/2008 | Metz et al. |
| 2008/0026440 A1 | 1/2008 | Metz et al. |
| 2008/0032296 A1 | 2/2008 | Weaver et al. |
| 2008/0032338 A1 | 2/2008 | Weaver et al. |
| 2008/0032351 A1 | 2/2008 | Metz et al. |
| 2008/0032367 A1 | 2/2008 | Weaver et al. |
| 2008/0032368 A1 | 2/2008 | Weaver et al. |
| 2008/0032369 A1 | 2/2008 | Weaver et al. |
| 2008/0038378 A1 | 2/2008 | Metz et al. |
| 2008/0038379 A1 | 2/2008 | Metz et al. |
| 2008/0038790 A1 | 2/2008 | Metz et al. |
| 2008/0038791 A1 | 2/2008 | Metz et al. |
| 2008/0038792 A1 | 2/2008 | Metz et al. |
| 2008/0038793 A1 | 2/2008 | Metz et al. |
| 2008/0038794 A1 | 2/2008 | Metz et al. |
| 2008/0038795 A1 | 2/2008 | Metz et al. |
| 2008/0038796 A1 | 2/2008 | Metz et al. |
| 2008/0038797 A1 | 2/2008 | Metz et al. |
| 2008/0038798 A1 | 2/2008 | Weaver et al. |
| 2008/0038799 A1 | 2/2008 | Weaver et al. |
| 2008/0040822 A1 | 2/2008 | Metz et al. |
| 2008/0044867 A1 | 2/2008 | Metz et al. |
| 2008/0044868 A1 | 2/2008 | Metz et al. |
| 2008/0044869 A1 | 2/2008 | Metz et al. |
| 2008/0044870 A1 | 2/2008 | Metz et al. |
| 2008/0044871 A1 | 2/2008 | Metz et al. |
| 2008/0044872 A1 | 2/2008 | Metz et al. |
| 2008/0044873 A1 | 2/2008 | Metz et al. |
| 2008/0044874 A1 | 2/2008 | Weaver et al. |
| 2008/0050790 A1 | 2/2008 | Metz et al. |
| 2008/0050791 A1 | 2/2008 | Weaver et al. |
| 2008/0148433 A1 | 6/2008 | Metz et al. |

FOREIGN PATENT DOCUMENTS

| | | |
|---|---|---|
| EP | 0594868 | 5/1994 |
| EP | 0823475 | 2/1998 |
| WO | WO 93/23545 | 11/1993 |
| WO | WO 96/21735 | 7/1996 |
| WO | WO 98/46764 | 10/1998 |
| WO | WO 98/55625 | 12/1998 |
| WO | WO 00/42195 | 7/2000 |
| WO | WO 02/083870 | 10/2002 |
| WO | WO 2004/087879 | 10/2004 |
| WO | WO 2006/008099 | 1/2006 |
| WO | WO 2006/034228 | 3/2006 |

OTHER PUBLICATIONS

Doerks et al, TIG 14(6): 248-250, Jun. 1998.*
Brenner, S.E. TIG 15(4): 132-133, Apr. 1999.*
Bork et al, TIG 12(10): 425-427, Oct. 1996.*
U.S. Appl. No. 11/674,574, filed Feb. 13, 2007, Facciotti et al.
U.S. Appl. No. 11/777,277, filed Jul. 12, 2007, Metz et al.
U.S. Appl. No. 11/778,594, filed Jul. 16, 2007, Metz et al.
U.S. Appl. No. 11/781,861, filed Jul. 23, 2007, Weaver et al.
U.S. Appl. No. 11/781,882, filed Jul. 23, 2007, Weaver et al.
Abbadi et al., Eur. J. Lipid Sci. Technol., 103:106-113 (2001).
Allen E.A. et al. 2002 "Structure and regulation of the omega-3 polyunsaturated fatty acid synthase genes from the deep-sea bacterium Photobacterium profundum strain SS9" Microbiology vol. 148 pp. 1903-1913.
Allen et al., Appl. Envir. Microbiol., 65(4):1710-1720 (1999).
Bateman et al., Nucl. Acids Res., 30(1):276-280 (2002).
Bentley et al., Annu. Rev. Microbiol., 53:411-46 (1999).
Bisang et al., Nature, 401:502-505 (1999).
Bork, Go hunting in sequence databases but watch out for the traps, 1996, TIG, vol. 12 No. 10, pp. 425-427.
Brenner, "Errors in genome annotation" 1999, TIG, vol. 15 No. 4, pp. 132-133.
Broun et al, "Catalytic Plasticity of Fatty Acid Modification Enzymes Underlying Chemical Diversity of Plant Lipids", 1998, Science vol. 282, pp. 1315-1317.
Cane et al., "Harnessing the Biosynthetic Code: Combinations, Permutations, and Mutations." Science 1998, vol. 282, pp. 63-68.
Chuck et al., "Molecular recognition of diketide substrates by a beta-ketoacyl-acyl carrier protein synthase domain within a bimodular polyketide synthase", Chem and Bio, Current Bio, (London), GB,, vol. 4, No. 10, 1997, pp. 757-766, XP000884721.
Creelman et al., Annu. Rev. Plan Physiol. Plant Mol. Biol., 48:355-81 (1997).
Database Geneseq 'Online! Dec. 11, 2000, "S. aggregatum PKS cluster ORF6 homolog DNA." XP002368912, retrieved from EBI accession No. GSN:AAA71567Database accession No. AAA71567—& Database Geneseq 'Online! Dec. 11, 2000, "S. aggregatum PKS cluster ORF6 homolog protein." XP002368914 retrieved from EBI accession No. GSP:AAB10482 Database accession No. AAB10482 & Wo 00/42195 A (Calgene, LLC) Jul. 20, 2000.
Delong & Yayanos, Appl. Environ. Microbiol, 51(4):730-737 (1986).
Doerks, "Protein annotation: detective work for function prediction", 1998, TIG vol. 14 No. 6, pp. 248-250.
Facciotti et al., "Cloning and Characterization of Polyunsaturated Fatty Acids (PUFA) Genes from Marine Bacteria" in Abstracts of the international symposium on progress and prospect of marine biotechnology (China Ocean Press) 1998, Abstract (p. 14).
GenBank Accession No. AF4091 00, (Allen et al.) 2002.
GenBank Accession No. U09865. Alcaligenes eutrophus pyruvate dehydrogenase (pdhA), dihydrolipoamide acetyltransferase (pdhB), dihydrolipoamide dehydrogenase (pdhL), and ORF3 genes, complete cds (1994).
Harlow et al. Antibodies: A Laboratory Manual (1988) Cold Spring Harbor Laboratory Press, p. 76.
Heath and Rock (1996) The Journal of Biological Chemistry, vol. 271, No. 41, pp. 27795-27801.
Hopwood & Sherman, (1990) Annu. Rev. Genet. 24:37-66.
Hutchinson, Annu. Rev. Microbiol., 49:201-238 (1995).
Jez et al., "Structural control of polyketide formation in plant-specific polyketide synthases", Chem and Bio (London), vol. 7, No. 12, Dec. 2000, pp. 919-930, XP002338564.
Jostensen & Landfald, (1997) "High prevalence of polyunsaturated-fatty-acid producing bacteria in arctic invertebrates" FEMS Microbiology Letters, 151:95-101.
Kaulmann et al. "Biosynthesis of Polyunsaturated Fatty Acids by Polyketide Synthases", Angew. Chem. Int. Ed. 2002, 41, No. 11, pp. 1866-1869.
Katz & Donadio, Annu. Rev. Microbiol., 47:875-912 (1993).
Kealey et al., "Production of a polyketide natural product in non-polyketide-producing prokaryotic and eukaryotic hosts", Proceedings of the National Academy of Sciences of the United States of America, vol. 95, No. 2, Jan. 20, 1998, pp. 505-509, XP002338563.
Keating et al., Curr. Opin. Chem. Biol., 3:598-606 (1999).
Khosla et al., "Tolerance and Specificity of Polyketide Synthases", Annu. Rev. Biochem. 1999. 68:219-253.
Kyle et al., "Long-chain Omega-3 Polyunsaturated Fatty Acids: Prospects for Introduction into Horticultural Food Plants," HortScience. vol. 25, Dec. 1990 pp. 1523-1526.
Leadlay PF. "Combinatorial Approaches to Polyketides Biosynthesis" Current Opinion in Chemical Biology (1997) 1: 162-168.
Magnuson, Microbil. Rev., 57(3):522-542 (1993) Abstract.
Metz et al., Science, 293:290-293 (2001).
Nakahara et al. Production of docosahexaenoic and docosapentaenoic acids by Schizochytrium sp. isloated from Yap Islands. 1996 J. Am. Oil Chem. Soc. 1996, vol. 73, No. 11, pp. 1421-1426.
Nakahara, Toro, "Physiological activity of docosahexaenoic acid (DHA) and its production by microbial culture," Yukagaku (1995) 44(10) pp. 821-827.
Napier "Plumbing the depths of PUFA biosynthesis: a novel polyketide synthase-like pathway from marine organisms." Trends in Plant Science. Feb. 2002, vol. 7, No. 2, pp. 51-54.

Nasu et al., "Efficient Transformation of Marchantia polymorpha That is Haploid and Has Very Small Genome DNA," Journal of Fermentation and Bioengineering vol. 84, No. 6, 519-523 1997.

Nichols et al., Curr. Opin. Biotechnol., 10:240-246 (1999).

Nicholson et al., "Design and utility of oligonucleotide gene probes for fungal polyketide synthases", Chem & Bio (London) vol. 8, No. 2, Feb. 2001, pp. 157-178, XP002338562.

Nogi et al., Extremophiles, 2:1-7 (1998).

Oliynuk et al. Chemistry & Biology (1996) 3: 833-839.

Orikasa et al. Characterization of the eicosapentaenoic acid biosynthesis gene cluster from Shewanella sp. strain SCRC-2738, Cellular and Molecular Biology (Noisy-le-grand), Jul. 2004, vol. 50, No. 5, pp. 625-630.

Parker-Barnes et al., PNAS, 97(15):8284-8289 (2000).

Qiu et al. Identification of a delta4 fatty acid desaturase from Thraustochytrium sp. involved in the biosynthesis. J. Biol. Chem. Aug. 24, 2001, vol. 276, No. 34, pp. 31561-31566.

Sánchez et al., Chemistry & Biology, 8:725-738 (2001).

Satomi et al. Shewanelia marinintesina sp. nov., Shewanella schlegeliana sp. nov. and Shewanelia sairae sp. nov., novel eicosapentaenoic-acid-producing marine bacteria isolated from see-animal intestines. Internat. J. Syst. Evol. Microbiol. 2003, vol. 53, pp. 491- 499.

Shanklin et al., Annu. Rev. Plant Physiol. Plant Mol. Biol., 49:611-41 (1998).

Singh et al. Microbial Production of Docosahexaenoic Acid (DHA, C22:6) Adv. Appl. Microbial, 1997. vol. 45, pp. 271-312.

Smith et al, The challenges of genome sequence annotation or "The devil is in the details", 1997, Nature Biotechnology vol. 15, pp. 1222-1223.

Somerville, Chris, "Future prospects for genetic modification of the composition of edible oils from higher plants," Am. J. Clin. Nutr. (1993) 58 pp. 270s-275s.

Takeyama et al. Expression of eicosapentaenoic acid synthesis gene clustter from Shewanella sp. in transgenic marine cyanobacterium. Synechecoccus sp. Microbiology. 1997, vol. 143, pp. 2725-2731.

UniProt Accession No. Q93CG6_PHOPR, (Allen et al.) 2002.

Van de Loo, "An oleate 12-hydroxylase from Ricinus communis L. is a fatty acyl desaturase homolog", 1995, Pro. Natl. Acad. Sci. vol. 92, pp. 6743-6747.

Wallis et al., "Polyunsaturated fatty acid synthesis: what will they think of next?", Tibs Trends in Bio Sciences, Elsevier Publ., Cambridge, EN, vol. 27, No. 9, Sep. 2002, pp. 467-473, XP004378766.

Watanabe et al., J. Biochem., 122:467-473 (1997).

Weete et al. Lipids and Ultrastructure of Thrauchytrium sp. ATCC26185. 1997, Am Oil Chem. Soc. vol. 32, No. 8, pp. 839-845.

Wiesmann et al. Biochemistry (1997) 36: 13849-13855.

Wiesmann et al. Biochemistry (1998) 37: 11012-11017.

Wiesmann et al. Chemistry & Biology (Sep. 1995) 2: 583-589.

Yalpani et al., The Plant Cell, 13:1401-1409 (2001).

Yazawa, (1996) Lipids 31 (supplement): S-297-S-300.

Yokochi et al. Optimization of docosahexaenoic acid production. App. Microbiol. Biotechnol. 1998, vol. 49, pp. 72-76.

International Search Report for International (PCT) Patent Application No. PCT/US02/12254, mailed Nov. 15, 2002.

International Preliminary Examination Report for International (PCT) Patent Application No. PCT/US02/12254, mailed Oct. 16, 2006.

International Search Report for International (PCT) Patent Application No. PCT/US00/00956, mailed Jul. 6, 2000.

Written Opinion for International (PCT) Patent Application No. PCT/US00/00956, mailed Dec. 19, 2000.

International Preliminary Examination Report for International (PCT) Patent Application No. PCT/US00/00956, mailed Apr. 19, 2001.

International Search Report for International (PCT) Patent Application No. PCT/US04/09323, mailed Apr. 4, 2007.

Written Opinion for International (PCT) Patent Application No. PCT/US04/09323, mailed Apr. 4, 2007.

International Preliminary Report on Patentability for International (PCT) Patent Application No. PCT/US04/09323, mailed May 9, 2007.

International Search Report for International (PCT) Patent Application No. PCT/US05/36998, mailed Mar. 22, 2007.

Written Opinion for International (PCT) Patent Application No. PCT/US05/36998, mailed Mar. 22, 2007.

International Search Report for International (PCT) Patent Application No. PCT/US08/63835, mailed Nov. 3, 2008.

Written Opinion for International (PCT) Patent Application No. PCT/US08/63835, mailed Nov. 3, 2008.

International Search Report for International (PCT) Patent Application No. PCT/US06/22893, mailed Feb. 29, 2008.

Written Opinion for International (PCT) Patent Application No. PCT/US06/22893, mailed Feb. 29, 2008.

International Search Report for International (PCT) Patent Application No. PCT/US07/64105, mailed Nov. 23, 2007.

Written Opinion for International (PCT) Patent Application No. PCT/US07/64105, mailed Nov. 23, 2007.

International Preliminary Report on Patentabililty for International (PCT) Patent Application No. PCT/US07/64105, mailed Sep. 25, 2008.

International Search Report for International (PCT) Patent Application No. PCT/US07/64104, mailed Dec. 5, 2008.

Written Opinion for International (PCT) Patent Application No. PCT/US07/64104, mailed Dec. 5, 2008.

International Search Report for International (PCT) Patent Application No. PCT/US2007/064106, mailed Sep. 16, 2008.

Written Opinion for International (PCT) Patent Application No. PCT/US2007/064106, mailed Sep. 16, 2008.

International Preliminary Report on Patentability for International (PCT) Patent Application No. PCT/US2007/064106, mailed October 30, 2008.

Bedford et al, "A functional chimeric modular polyketide synthase generated via domain replacement." Chemistry & Biology 3: 827-831, Oct. 1996.

Fan K W et al: "Eicosapentaenoic and docosahexaenoic acids production by and okara-utilizing potential of thraustochytrids" Journal of Industrial Microbiology and Biotechnology, Basingstoke, GB, vol. 27, No. 4, Oct. 1, 2001, pp. 199-202, XP002393382 ISSN: 1367-5435.

Grimsley et al, "Fatty acid composition of mutants of the moss Physcomitrella patens" Phytochemistry 20(7): 1519-1524, 1981.

Wolff et al, Arachidonic, Eicosapentaenoic and Biosynthetically Related Fatty Acids in Seed Lipids from a primitive Gymnosperm, Agathis robusta. Lipids 34(10), 1994, 1083-1097.

Sequence alignment for SEQ ID No:5 with SEQID No. 17 from US Patent 5,683,898. Search resulted dated Aug. 5, 2009.

Sequence alignment for SEQ ID No. 1 with SEQID No. 16 from US Patent 5,683,898. Search resulted dated Aug. 5, 2009.

Sequence alignment of SEQ ID No.: 7 with SEQ ID No. 1 of Yazawa, US Patent 5,798,259, search result date Aug. 10, 2009.

Sequence alignment of SEQ ID No. 11 with SEQ ID No. 16 of Yazawa, US Patent 5,798,259, search result date Aug. 10, 2009.

International Preliminary Report on Patentability for International (PCT) Patent Application No. PCT/US07/64104, mailed Mar. 19, 2009.

* cited by examiner

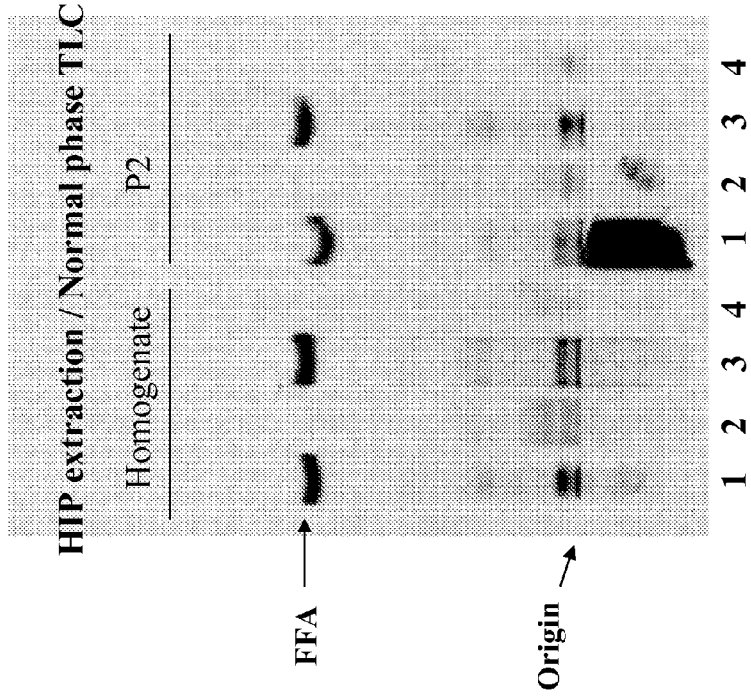
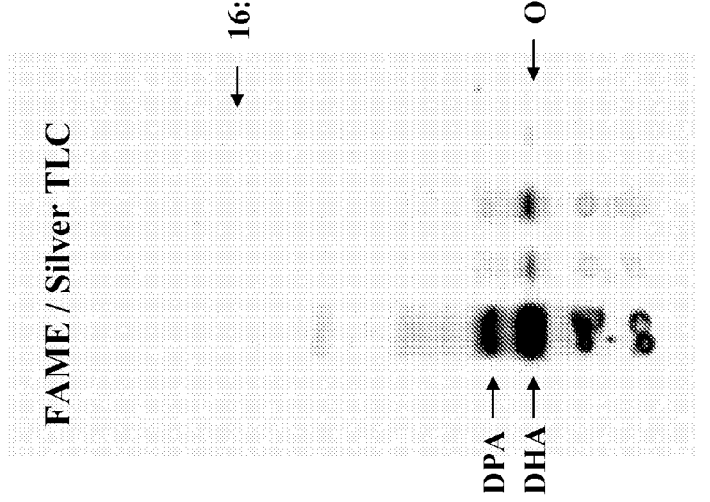

FIG. 8
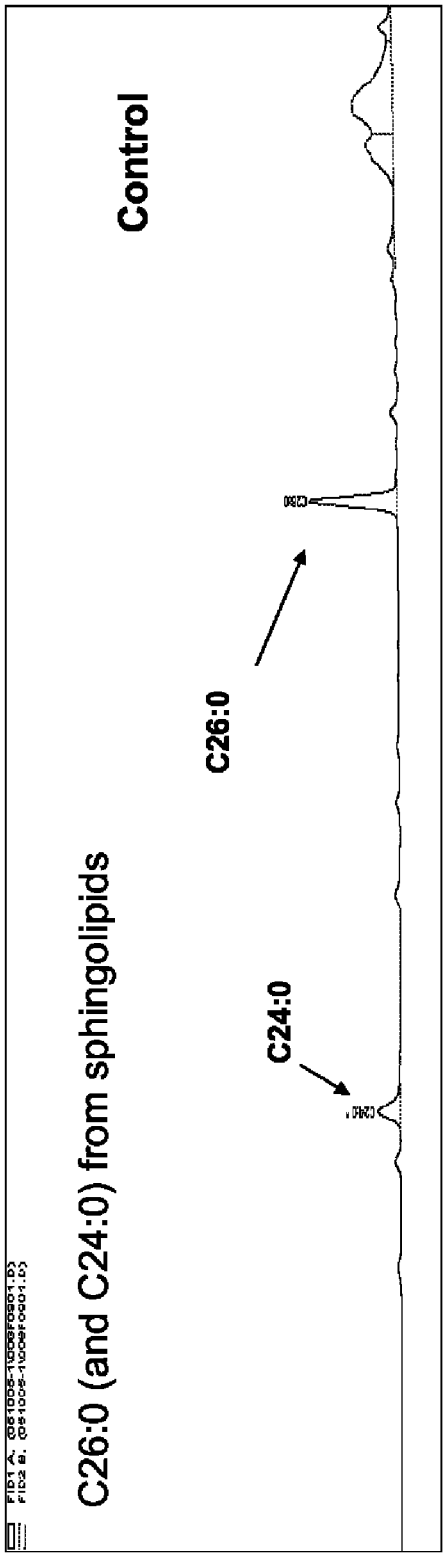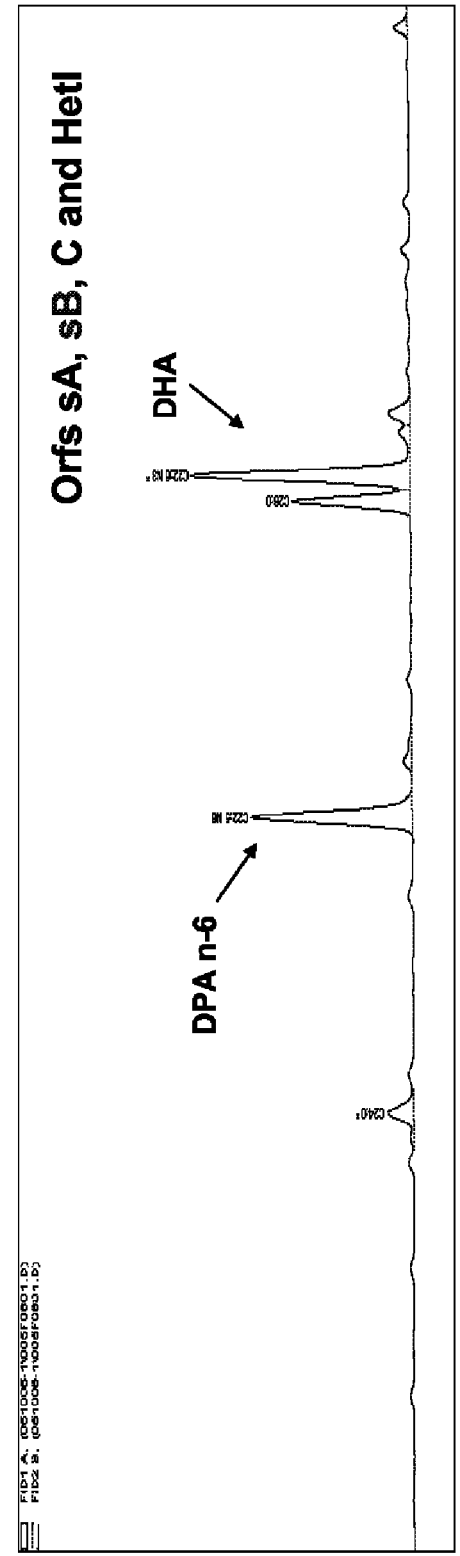

TLC / Iodine stain – lipid extracts

Sterol esters

TAG

DAG

Lipid Class Profile

| Sample ID | WT<br>Wild type 20688 | KO<br>DAGAT1 KO B73-8 |
|---|---|---|
| Hydrocarbons e.g., squalene | ND | 7.8 |
| Sterol esters | 2.6 | ND |
| Triglycerides | 56.5 | 4.0 |
| FFA | ND | 0.8 |
| Diglycerides | 2.2 | 6.8 |
| Phospholipids | 17.7 | 42.3 |
| Total recovery | 79.0 | 61.7 |

Reported in percent = (weight of specific lipid class/weight of total sample) x 100
ND = none detected, below detection limits

POLYUNSATURATED FATTY ACID PRODUCTION IN HETEROLOGOUS ORGANISMS USING PUFA POLYKETIDE SYNTHASE SYSTEMS

CROSS-REFERENCE TO RELATED APPLICATIONS

This application claims the benefit of priority under 35 U.S.C. §119(e) from U.S. Provisional Application Ser. No. 60/784,616, filed Mar. 21, 2006, and from U.S. Provisional Application Ser. No. 60/783,205, filed Mar. 15, 2006. The entire disclosure of each of U.S. Provisional Application Ser. No. 60/784,616 and U.S. Provisional Application Ser. No. 60/783,205, filed Mar. 15, 2006 is incorporated herein by reference.

FIELD OF THE INVENTION

The present invention generally relates to the use of accessory proteins and targets to improve the production of polyunsaturated fatty acids (PUFAs) and particularly, long chain PUFAs (LCPUFAs), in a host organism that has been genetically modified with a PKS-like system for producing such PUFAs (i.e., a PUFA PKS system or a PUFA synthase). The present invention also relates to the organisms that have been genetically modified to express such accessory proteins or modified with respect to such targets, and to methods of making and using such organisms.

BACKGROUND OF THE INVENTION

Polyunsaturated fatty acids (PUFAs) are considered to be useful for nutritional applications, pharmaceutical applications, industrial applications, and other purposes. However, the current supply of PUFAs from natural sources and from chemical synthesis is not sufficient for commercial needs. Vegetable oils derived from oil seed crops are relatively inexpensive and do not have the contamination issues associated with fish oils. However, the PUFAs found in commercially developed plant oils are typically limited to linoleic acid (eighteen carbons with 2 double bonds, in the delta 9 and 12 positions—18:2 delta 9, 12) and linolenic acid (18:3 delta 9, 12, 15). A number of separate desaturase and elongase enzymes are required for fatty acid synthesis from linoleic and linolenic acids to produce the more saturated and longer chain PUFAs. Therefore, engineering plant host cells for the expression of PUFAs such as EPA and docosahexaenoic acid (DHA) may require expression of several separate enzymes to achieve synthesis. Additionally, for production of useable quantities of such PUFAs, additional engineering efforts may be required. Therefore, the discovery of an alternate system for the production of PUFAs, which is a polyketide synthase-like system, has provided a significant alternative to the genetic engineering of plants or other organisms (e.g., microorganisms) using the desaturases and elongases of the "classical" or "standard" fatty acid synthesis pathway.

There have been many efforts to produce PUFAs in oil-seed crop plants by modification of the endogenously-produced fatty acids. Genetic modification of these plants with various individual genes for fatty acid elongases and desaturases has produced leaves or seeds containing significant levels of PUFAs such as EPA, but also containing significant levels of mixed shorter-chain and less unsaturated PUFAs (Qi et al., *Nature Biotech.* 22:739 (2004); PCT Publication No. WO 04/071467; Abbadi et al., *Plant Cell* 16:1 (2004)); Napier and Sayanova, Proceedings of the Nutrition Society (2005), 64:387-393; Robert et al., Functional Plant Biology (2005) 32:473-479; or U.S. Patent Application Publication 2004/0172682.

Therefore, there remains a need in the art for a method to efficiently and effectively produce quantities of lipids (e.g., triacylglycerol (TAG) and phospholipid (PL)) enriched in desired PUFAs in oil-seed plants.

Polyketide synthase (PKS) systems are generally known in the art as enzyme complexes related to fatty acid synthase (FAS) systems, but which are often highly modified to produce specialized products that typically show little resemblance to fatty acids. It has now been shown, however, that polyketide synthase systems exist in marine bacteria and certain microalgae that are capable of synthesizing polyunsaturated fatty acids (PUFAs) from acetyl-CoA and malonyl-CoA. These systems are referred to herein as PUFA PKS systems, PKS-like systems for the production of PUFAs, or PUFA synthase systems, all of which are used interchangeably herein.

The PUFA PKS pathways for PUFA synthesis in *Shewanella* and another marine bacteria, *Vibrio marinus*, are described in detail in U.S. Pat. No. 6,140,486. The PUFA PKS pathways for PUFA synthesis in the eukaryotic Thraustochytrid, *Schizochytrium*, is described in detail in U.S. Pat. No. 6,566,583. The PUFA PKS pathways for PUFA synthesis in eukaryotes such as members of Thraustochytriales, including the additional description of a PUFA PKS system in *Schizochytrium* and the identification of a PUFA PKS system in *Thraustochytrium*, including details regarding uses of these systems, are described in detail in U.S. Patent Application Publication No. 20020194641, published Dec. 19, 2002 and in PCT Publication No. WO 2006/135866, published Dec. 21, 2006. U.S. Patent Application Publication No. 20040235127, published Nov. 25, 2004, discloses the detailed structural description of a PUFA PKS system in *Thraustochytrium*, and further detail regarding the production of eicosapentaenoic acid (C20:5, ω-3) (EPA) and other PUFAs using such systems. U.S. Patent Application Publication No. 20050100995, published May 12, 2005, discloses the structural and functional description of PUFA PKS systems in *Shewanella olleyana* and *Shewanella japonica*, and uses of such systems. These applications also disclose the genetic modification of organisms, including microorganisms and plants, with the genes comprising the PUFA PKS pathway and the production of PUFAs by such organisms. Furthermore, PCT Patent Publication No. WO 05/097982 describes a PUFA PKS system in *Ulkenia*, and U.S. Patent Application Publication No. 20050014231 describes PUFA PKS genes and proteins from *Thraustochytrium aureum*. Each of the above-identified applications is incorporated by reference herein in its entirety.

Accordingly, the basic domain structures and sequence characteristics of the PUFA synthase family of enzymes have been described, and it has been demonstrated that PUFA synthase enzymes are capable of de novo synthesis of various PUFAs (e.g., eicosapentaenoic acid (EPA; C20:5n-3), docosahexaenoic acid (DHA; 22:6n-3) and docosapentaenoic acid (DPAn-6; C22:5n-6). It has also been demonstrated that the PUFA products can accumulate in host organism phospholipids (PL) and, in some cases, in the neutral lipids (e.g., triacylglycerols (TAG)). However, to the best of the present inventors' knowledge, the precise mechanism for the transfer of the PUFA from the enzyme to those targets has not been defined prior to the present invention.

Since the mechanism of transfer of PUFAs to target destinations in an organism can have implications for increasing the efficiency of and/or improving the production of PUFAs in an organism that has been genetically modified to produce such PUFAs, there is a need in the art for information regarding this mechanism. Accordingly, there is also a need in the art for improved methods of production of PUFAs, including in plants and microorganisms that have been genetically modified to produce such PUFAs, which take advantage of the knowledge of such mechanism.

SUMMARY OF THE INVENTION

One embodiment of the invention relates to an isolated nucleic acid molecule comprising a nucleic acid sequence encoding an acyl-CoA synthetase (ACoAS) that catalyzes the conversion of long chain PUFA free fatty acids (FFA) to acyl-CoA, wherein the nucleic acid sequence encodes an acyl-CoA synthetase (ACoAS) that is at least 60% identical to an ACoAS having an amino acid sequence selected from the group consisting of: SEQ ID NO:83, SEQ ID NO:85, SEQ ID NO:87, SEQ ID NO:89, SEQ ID NO:91, SEQ ID NO:93, SEQ ID NO:95, SEQ ID NO:97 and SEQ ID NO:99. In one aspect, the nucleic acid sequence encodes an acyl-CoA synthetase (ACoAS) having an amino acid sequence selected from the group consisting of: SEQ ID NO:83, SEQ ID NO:85, SEQ ID NO:87, SEQ ID NO:89, SEQ ID NO:91, SEQ ID NO:93, SEQ ID NO:95, SEQ ID NO:97 and SEQ ID NO:99. In one aspect, the nucleic acid sequence encodes an amino acid sequence selected from the group consisting of: SEQ ID NO:83, SEQ ID NO:85 and SEQ ID NO:97. In one aspect, the nucleic acid sequence is selected from the group consisting of: SEQ ID NO:82, SEQ ID NO:84, SEQ ID NO:86, SEQ ID NO:88, SEQ ID NO:90, SEQ ID NO:92, SEQ ID NO:94, SEQ ID NO:96, and SEQ ID NO:98.

Yet another embodiment of the invention relates to an isolated nucleic acid molecule comprising a nucleic acid sequence that encodes a protein that utilizes PUFA-CoA as substrates in forming phospholipids (PL) or triacylglycerols (TAG), wherein the protein comprises an amino acid sequence that is at least 60% identical to an amino acid sequence selected from the group consisting of: SEQ ID NO:102, SEQ ID NO:104, SEQ ID NO:107, SEQ ID NO:110, and SEQ ID NO:113. In one aspect, the nucleic acid sequence encodes a protein comprising an amino acid sequence selected from the group consisting of: SEQ ID NO:102, SEQ ID NO:104, SEQ ID NO:107, SEQ ID NO:100, and SEQ ID NO:113. In one aspect, the nucleic acid sequence encodes a protein comprising an amino acid sequence selected from the group consisting of SEQ ID NO:102 and SEQ ID NO:104. In one aspect, the nucleic acid sequence is selected from the group consisting of SEQ ID NO: 100, SEQ ID NO:102, SEQ ID NO:103, SEQ ID NO:105, SEQ ID NO:106, SEQ ID NO:108, SEQ ID NO:109, SEQ ID NO:111, and SEQ ID NO:112.

Another embodiment of the invention relates to an isolated protein encoded by any of the above-described nucleic acid molecules.

Another embodiment of the invention relates to a recombinant nucleic acid molecule, comprising any of the above-described nucleic acid molecules, operatively linked to an expression control sequence.

Yet another embodiment of the invention relates to a recombinant host cell comprising any of the above-described recombinant nucleic acid molecules. In one aspect, the host cell is a microorganism. In another aspect, the host cell is a plant cell.

Another embodiment of the invention relates to a genetically modified organism, wherein the organism has been genetically modified to express any of the above-described nucleic acid molecules or any combination thereof. In one aspect, the organism expresses a PUFA synthase and a phosphopantetheinyl transferase (PPTase). In one aspect, the organism has been genetically modified to express the synthase and the PPTase. In one aspect, the contains an additional genetic modification to delete or inactivate a fatty acid synthase (FAS) expressed by the organism. In one aspect, the organism contains an additional genetic modification to reduce competition for malonyl CoA with the PUFA synthase or to increase the level of malonyl CoA in the organism.

Another embodiment relates to a genetically modified organism, wherein the organism expresses a PUFA synthase that produces at least one polyunsaturated fatty acid (PUFA) and a phosphopantetheinyl transferase (PPTase), and wherein the organism contains a genetic modification to express one or more heterologous acyl-CoA synthetases (ACoAS) or a homologue thereof that catalyzes the conversion of long chain PUFA free fatty acids (FFA) to acyl-CoA. In one aspect, the organism is transformed with a nucleic acid molecule comprising a nucleic acid sequence encoding an acyl-CoA synthetase (ACoAS) or a homologue thereof from an organism that endogenously expresses a PUFA synthase. In one aspect, the organism is transformed with a nucleic acid molecule comprising a nucleic acid sequence encoding an acyl-CoA synthetase (ACoAS) or a homologue thereof from *Crypthecodinium cohnii*, wherein the ACoAS or homologue thereof catalyzes the conversion of long chain PUFA free fatty acids (FFA) to acyl-CoA. In one aspect, the organism is transformed with a nucleic acid molecule comprising a nucleic acid sequence encoding an acyl-CoA synthetase (ACoAS) or a homologue thereof from a Thraustochytriales microorganism, wherein the ACoAS or homologue thereof catalyzes the conversion of long chain PUFA free fatty acids (FFA) to acyl-CoA. In one aspect, the organism is transformed with a nucleic acid molecule comprising a nucleic acid sequence encoding an acyl-CoA synthetase (ACoAS) or a homologue thereof from *Schizochytrium*, wherein the ACoAS or homologue thereof catalyzes the conversion of long chain PUFA free fatty acids (FFA) to acyl-CoA. In one aspect, the organism contains an additional genetic modification to delete or inactivate a fatty acid synthase (FAS) expressed by the organism. In one aspect, the organism contains an additional genetic modification to reduce competition for malonyl CoA with the PUFA synthase or to increase the level of malonyl CoA in the organism. In one aspect, the organism contains an additional genetic modification to express one or more heterologous proteins from an organism that endogenously produces PUFAs, wherein the protein utilizes PUFA-CoA as substrates in forming phospholipids (PL) or triacylglycerols (TAG).

Another embodiment relates to a genetically modified organism, wherein the organism expresses a PUFA synthase that produces at least one polyunsaturated fatty acid (PUFA) and a phosphopantetheinyl transferase (PPTase), and wherein the organism contains a genetic modification to delete or inactivate a fatty acid synthase (FAS) expressed by the organism. In one aspect, the organism contains an additional genetic modification to reduce competition for malonyl CoA with the PUFA synthase or to increase the level of malonyl CoA in the organism.

Another embodiment relates to a genetically modified organism, wherein the organism expresses a PUFA synthase that produces at least one polyunsaturated fatty acid (PUFA) and a phosphopantetheinyl transferase (PPTase), and wherein the organism contains a genetic modification to reduce competition for malonyl CoA with the PUFA synthase or to increase the level of malonyl CoA in the organism. In one aspect, the organism contains an additional genetic modification to delete or inactivate a fatty acid synthase (FAS) expressed by the organism.

Yet another embodiment relates to a genetically modified organism, wherein the organism expresses a PUFA synthase that produces at least one polyunsaturated fatty acid (PUFA) and a phosphopantetheinyl transferase (PPTase), wherein the organism contains a genetic modification to express one or more heterologous proteins from an organism that endogenously produces PUFAs, wherein the protein utilizes PUFA-CoA as substrates in forming phospholipids (PL) or triacylglycerols (TAG). In one aspect, the protein is a DAGAT or an LPAAT. In one aspect, the organism is transformed with a nucleic acid molecule comprising a nucleic acid sequence encoding a protein from a Thraustochytrid or a Labyrinthulid that utilizes PUFA-CoA as substrates in forming phospholipids (PL) or triacylglycerols (TAG). In one aspect, the organism is transformed with a nucleic acid molecule comprising a nucleic acid sequence encoding a protein from *Schizochytrium* that utilizes PUFA-CoA as substrates in forming phospholipids (PL) or triacylglycerols (TAG). In one aspect, the organism comprises an additional modification to express one or more heterologous acyl-CoA synthetases (ACoAS) or a homologue thereof that catalyzes the conversion of long chain PUFA free fatty acids (FFA) to acyl-CoA. In one aspect, the organism contains an additional genetic modification to delete or inactivate a fatty acid synthase (FAS) expressed by the organism. In one aspect, the organism contains an additional genetic modification to reduce competition for malonyl CoA with the PUFA synthase or to increase the level of malonyl CoA in the organism.

In one embodiment, the invention provides a genetically modified organism, including a microorganism, plant, part of the plant, or plant cell, wherein the organism has been genetically modified with a PUFA synthase that produces at least one polyunsaturated fatty acid (PUFA) and a phosphopantetheinyl transferase (PPTase), and wherein the organism contains a genetic modification to inhibit the expression or activity of a protein selected from the group consisting of KASII and KASIII.

In another embodiment, the invention provides a genetically modified organism, including a microorganism, plant, part of the plant, or plant cell, wherein the organism has been genetically modified with a PUFA synthase that produces at least one polyunsaturated fatty acid (PUFA) and a phosphopantetheinyl transferase (PPTase), and wherein at least one nucleic acid molecule encoding the PUFA synthase or the PPTase is operatively linked to a nucleic acid sequence encoding a plastid-targeting sequence represented by SEQ ID NO:81.

In a further embodiment, the invention provides a genetically modified organism, including a microorganism, plant, part of the plant, or plant cell wherein the organism has been genetically modified with a PUFA synthase that produces at least one polyunsaturated fatty acid (PUFA) and a phosphopantetheinyl transferase (PPTase), and wherein the organism contains a genetic modification to inhibit the expression or activity of a protein selected from the group consisting of KASII and KASIII, and wherein the organism contains an additional genetic modification to express one or more heterologous acyl-CoA synthetases (ACoAS) or a homologue thereof that catalyzes the conversion of long chain PUFA free fatty acids (FFA) to acyl-CoA.

In yet a further embodiment, the invention provides a genetically modified organism, including a microorganism, plant, part of the plant, or plant cell wherein the organism has been genetically modified with a PUFA synthase that produces at least one polyunsaturated fatty acid (PUFA) and a phosphopantetheinyl transferase (PPTase); wherein at least one nucleic acid molecule encoding the PUFA synthase or the PPTase is operatively linked to a nucleic acid sequence encoding a plastid-targeting sequence, including, but not limited to that represented by SEQ ID NO:81; or wherein the organism contains an additional genetic modification to express one or more heterologous acyl-CoA synthetases (ACoAS) or a homologue thereof that catalyzes the conversion of long chain PUFA free fatty acids (FFA) to acyl-CoA.

In one embodiment, the invention provides a genetically modified organism, including a microorganism, plant, part of the plant, or plant cell, wherein the organism has been genetically modified with a PUFA synthase that produces at least one polyunsaturated fatty acid (PUFA) and a phosphopantetheinyl transferase (PPTase); wherein the organism contains a genetic modification to inhibit the expression or activity of a protein, e.g., a protein selected from the group consisting of KASII and KASIII; wherein the organism contains an additional genetic modification to express one or more heterologous proteins from an organism that endogenously produces PUFAs; and wherein the protein utilizes PUFA-CoA as substrates in forming phospholipids (PL) or triacylglycerols (TAG).

In yet another embodiment, the invention provides a genetically modified organism, including a microorganism, plant, part of the plant, or plant cell, wherein the organism has been genetically modified with a PUFA synthase that produces at least one polyunsaturated fatty acid (PUFA) and a phosphopantetheinyl transferase (PPTase); wherein the organism contains a genetic modification to inhibit the expression or activity of a protein, e.g., a protein selected from the group consisting of KASII and KASIII; wherein the organism contains an additional genetic modification to express one or more heterologous proteins from an organism that endogenously produces PUFAs; wherein the protein utilizes PUFA-CoA as substrates in forming phospholipids (PL) or triacylglycerols (TAG); and wherein the organism contains an additional genetic modification to express one or more heterologous acyl-CoA synthetases (ACoAS) or a homologue thereof that catalyzes the conversion of long chain PUFA free fatty acids (FFA) to acyl-CoA.

In another embodiment, the invention provides a genetically modified organism, including a microorganism, plant, part of the plant, or plant cell, wherein the organism has been genetically modified with a PUFA synthase that produces at least one polyunsaturated fatty acid (PUFA) and a phosphopantetheinyl transferase (PPTase); wherein at least one nucleic acid molecule encoding the PUFA synthase or the PPTase is operatively linked to a nucleic acid sequence encoding a plastid-targeting sequence, including, but not limited to that represented by SEQ ID NO:81; wherein the organism contains an additional genetic modification to express one or more heterologous proteins from an organism that endogenously produces PUFAs, wherein the protein utilizes PUFA-CoA as substrates in forming phospholipids (PL) or triacylglycerols (TAG).

In another embodiment, the invention provides a genetically modified organism, including a microorganism, plant, part of the plant, or plant cell, wherein the organism has been genetically modified with a PUFA synthase that produces at least one polyunsaturated fatty acid (PUFA) and a phosphopantetheinyl transferase (PPTase); wherein at least one nucleic acid molecule encoding the PUFA synthase or the PPTase is operatively linked to a nucleic acid sequence encoding a plastid-targeting sequence, including, but not limited to that represented by SEQ ID NO:81; wherein the organism contains an additional genetic modification to express one or more heterologous proteins from an organism that endogenously produces PUFAs, wherein the protein utilizes PUFA-CoA as substrates in forming phospholipids (PL) or triacylglycerols (TAG); and wherein the organism contains an additional genetic modification to express one or more heterologous acyl-CoA synthetases (ACoAS) or a homologue thereof that catalyzes the conversion of long chain PUFA free fatty acids (FFA) to acyl-CoA.

In one embodiment, the invention provides a genetically modified organism, including a microorganism, plant, part of the plant, or plant cell, wherein the organism has been genetically modified with a PUFA synthase that produces at least one polyunsaturated fatty acid (PUFA) and a phosphopantetheinyl transferase (PPTase); wherein the organism contains a genetic modification to inhibit the expression or activity of a protein, e.g., a protein selected from the group consisting of KASII and KASIII; and wherein the organism comprises an additional genetic modification to delete or inactivate an endogenous fatty acid synthase (FAS) or protein associated with an FAS expressed by the organism.

In one embodiment, the invention provides a genetically modified organism, including a microorganism, plant, part of the plant, or plant cell, wherein the organism has been genetically modified with a PUFA synthase that produces at least one polyunsaturated fatty acid (PUFA) and a phosphopantetheinyl transferase (PPTase); wherein the organism contains a genetic modification to inhibit the expression or activity of a protein, e.g., a protein selected from the group consisting of KASII and KASIII; wherein the organism comprises an additional genetic modification to delete or inactivate an endogenous fatty acid synthase (FAS) or protein associated with an FAS expressed by the organism; and wherein the organism contains an additional genetic modification to express one or more heterologous acyl-CoA synthetases (ACoAS) or a homologue thereof that catalyzes the conversion of long chain PUFA free fatty acids (FFA) to acyl-CoA.

In one embodiment, the invention provides a genetically modified organism, including a microorganism, plant, part of the plant, or plant cell, wherein the organism has been genetically modified with a PUFA synthase that produces at least one polyunsaturated fatty acid (PUFA) and a phosphopantetheinyl transferase (PPTase); wherein the organism contains a genetic modification to inhibit the expression or activity of a protein, e.g., a protein selected from the group consisting of KASII and KASIII; wherein the organism comprises an additional genetic modification to delete or inactivate an endogenous fatty acid synthase (FAS) or protein associated with an FAS expressed by the organism; wherein the organism contains an additional genetic modification to express one or more heterologous proteins from an organism that endogenously produces PUFAs; and wherein the protein utilizes PUFA-CoA as substrates in forming phospholipids (PL) or triacylglycerols (TAG).

In one embodiment, the invention provides a genetically modified organism, including a microorganism, plant, part of the plant, or plant cell, wherein the organism has been genetically modified with a PUFA synthase that produces at least one polyunsaturated fatty acid (PUFA) and a phosphopantetheinyl transferase (PPTase); wherein the organism contains a genetic modification to inhibit the expression or activity of a protein, e.g., a protein selected from the group consisting of KASII and KASIII; wherein the organism comprises an additional genetic modification to delete or inactivate an endogenous fatty acid synthase (FAS) or protein associated with an FAS expressed by the organism; wherein the organism contains an additional genetic modification to express one or more heterologous acyl-CoA synthetases (ACoAS) or a homologue thereof that catalyzes the conversion of long chain PUFA free fatty acids (FFA) to acyl-CoA; wherein the organism contains an additional genetic modification to express one or more heterologous proteins from an organism that endogenously produces PUFAs; and wherein the protein utilizes PUFA-CoA as substrates in forming phospholipids (PL) or triacylglycerols (TAG). In another embodiment, the invention provides a genetically modified organism, including a microorganism, plant, part of the plant, or plant cell, wherein the organism has been genetically modified with a PUFA synthase that produces at least one polyunsaturated fatty acid (PUFA) and a phosphopantetheinyl transferase (PPTase); wherein at least one nucleic acid molecule encoding the PUFA synthase or the PPTase is operatively linked to a nucleic acid sequence encoding a plastid-targeting sequence, including, but not limited to that represented by SEQ ID NO:81; and wherein the organism comprises an additional genetic modification to delete or inactivate an endogenous fatty acid synthase (FAS) or protein associated with an FAS expressed by the organism.

In another embodiment, the invention provides a genetically modified organism, including a microorganism, plant, part of the plant, or plant cell, wherein the organism has been genetically modified with a PUFA synthase that produces at least one polyunsaturated fatty acid (PUFA) and a phosphopantetheinyl transferase (PPTase); wherein at least one nucleic acid molecule encoding the PUFA synthase or the PPTase is operatively linked to a nucleic acid sequence encoding a plastid-targeting sequence, including, but not limited to that represented by SEQ ID NO:81; wherein the organism comprises an additional genetic modification to delete or inactivate an endogenous fatty acid synthase (FAS) or protein associated with an FAS expressed by the organism; and wherein the organism contains an additional genetic modification to express one or more heterologous acyl-CoA synthetases (ACoAS) or a homologue thereof that catalyzes the conversion of long chain PUFA free fatty acids (FFA) to acyl-CoA.

In another embodiment, the invention provides a genetically modified organism, including a microorganism, plant, part of the plant, or plant cell, wherein the organism has been genetically modified with a PUFA synthase that produces at least one polyunsaturated fatty acid (PUFA) and a phosphopantetheinyl transferase (PPTase); wherein at least one nucleic acid molecule encoding the PUFA synthase or the PPTase is operatively linked to a nucleic acid sequence encoding a plastid-targeting sequence, including, but not limited to that represented by SEQ ID NO:81; wherein the organism comprises an additional genetic modification to delete or inactivate an endogenous fatty acid synthase (FAS) or protein associated with an FAS expressed by the organism; wherein the organism contains an additional genetic modification to express one or more heterologous proteins from an organism that endogenously produces PUFAs; and wherein the protein utilizes PUFA-CoA as substrates in forming phospholipids (PL) or triacylglycerols (TAG).

In another embodiment, the invention provides a genetically modified organism, including a microorganism, plant, part of the plant, or plant cell, wherein the organism has been genetically modified with a PUFA synthase that produces at least one polyunsaturated fatty acid (PUFA) and a phosphopantetheinyl transferase (PPTase); wherein at least one nucleic acid molecule encoding the PUFA synthase or the PPTase is operatively linked to a nucleic acid sequence encoding a plastid-targeting sequence, including, but not limited to that represented by SEQ ID NO:81; wherein the organism comprises an additional genetic modification to delete or inactivate an endogenous fatty acid synthase (FAS) or protein associated with an FAS expressed by the organism; wherein the organism contains an additional genetic modification to express one or more heterologous acyl-CoA synthetases (ACoAS) or a homologue thereof that catalyzes the conversion of long chain PUFA free fatty acids (FFA) to acyl-CoA; and wherein the organism contains an additional genetic modification to express one or more heterologous proteins from an organism that endogenously produces PUFAs; and wherein the protein utilizes PUFA-CoA as substrates in forming phospholipids (PL) or triacylglycerols (TAG).

In one embodiment, the invention provides a genetically modified organism, including a microorganism, plant, part of the plant, or plant cell, wherein the organism has been genetically modified with a PUFA synthase that produces at least one polyunsaturated fatty acid (PUFA) and a phosphopantetheinyl transferase (PPTase), and wherein the organism contains a genetic modification to inhibit the expression or activity of a protein, e.g., a protein selected from the group consisting of KASII and KASIII, wherein the organism comprises an additional genetic modification to reduce competition for malonyl CoA with the PUFA synthase or to increase the level of malonyl CoA in the organism.

In one embodiment, the invention provides a genetically modified organism, including a microorganism, plant, part of the plant, or plant cell, wherein the organism has been genetically modified with a PUFA synthase that produces at least one polyunsaturated fatty acid (PUFA) and a phosphopantetheinyl transferase (PPTase), and wherein the organism contains a genetic modification to inhibit the expression or activity of a protein, e.g., a protein selected from the group consisting of KASII and KASIII, wherein the organism comprises an additional genetic modification to reduce competition for malonyl CoA with the PUFA synthase or to increase the level of malonyl CoA in the organism; and wherein the organism contains an additional genetic modification to express one or more heterologous acyl-CoA synthetases (ACoAS) or a homologue thereof that catalyzes the conversion of long chain PUFA free fatty acids (FFA) to acyl-CoA.

In one embodiment, the invention provides a genetically modified organism, including a microorganism, plant, part of the plant, or plant cell, wherein the organism has been genetically modified with a PUFA synthase that produces at least one polyunsaturated fatty acid (PUFA) and a phosphopantetheinyl transferase (PPTase), and wherein the organism contains a genetic modification to inhibit the expression or activity of a protein, e.g., a protein selected from the group consisting of KASII and KASIII, wherein the organism comprises an additional genetic modification to reduce competition for malonyl CoA with the PUFA synthase or to increase the level of malonyl CoA in the organism; wherein the organism contains an additional genetic modification to express one or more heterologous proteins from an organism that endogenously produces PUFAs; and wherein the protein utilizes PUFA-CoA as substrates in forming phospholipids (PL) or triacylglycerols (TAG).

In one embodiment, the invention provides a genetically modified organism, including a microorganism, plant, part of the plant, or plant cell, wherein the organism has been genetically modified with a PUFA synthase that produces at least one polyunsaturated fatty acid (PUFA) and a phosphopantetheinyl transferase (PPTase), and wherein the organism contains a genetic modification to inhibit the expression or activity of a protein, e.g., a protein selected from the group consisting of KASII and KASIII, wherein the organism comprises an additional genetic modification to reduce competition for malonyl CoA with the PUFA synthase or to increase the level of malonyl CoA in the organism; and wherein the organism comprises an additional genetic modification to delete or inactivate an endogenous fatty acid synthase (FAS) or protein associated with an FAS expressed by the organism.

In one embodiment, the invention provides a genetically modified organism, including a microorganism, plant, part of the plant, or plant cell, wherein the organism has been genetically modified with a PUFA synthase that produces at least one polyunsaturated fatty acid (PUFA) and a phosphopantetheinyl transferase (PPTase), and wherein the organism contains a genetic modification to inhibit the expression or activity of a protein, e.g., a protein selected from the group consisting of KASII and KASIII, wherein the organism comprises an additional genetic modification to reduce competition for malonyl CoA with the PUFA synthase or to increase the level of malonyl CoA in the organism; wherein the organism contains an additional genetic modification to express one or more heterologous acyl-CoA synthetases (ACoAS) or a homologue thereof that catalyzes the conversion of long chain PUFA free fatty acids (FFA) to acyl-CoA; wherein the organism contains an additional genetic modification to express one or more heterologous proteins from an organism that endogenously produces PUFAs; and wherein the protein utilizes PUFA-CoA as substrates in forming phospholipids (PL) or triacylglycerols (TAG). In one embodiment, the invention provides a genetically modified organism, including a microorganism, plant, part of the plant, or plant cell, wherein the organism has been genetically modified with a PUFA synthase that produces at least one polyunsaturated fatty acid (PUFA) and a phosphopantetheinyl transferase (PPTase), and wherein the organism contains a genetic modification to inhibit the expression or activity of a protein, e.g., a protein selected from the group consisting of KASII and KASIII, wherein the organism comprises an additional genetic modification to reduce competition for malonyl CoA with the PUFA synthase or to increase the level of malonyl CoA in the organism; wherein the organism contains an additional genetic modification to express one or more heterologous acyl-CoA synthetases (ACoAS) or a homologue thereof that catalyzes the conversion of long chain PUFA free fatty acids (FFA) to acyl-CoA; and wherein the organism comprises an additional genetic modification to delete or inactivate an endogenous fatty acid synthase (FAS) or protein associated with an FAS expressed by the organism.

In one embodiment, the invention provides a genetically modified organism, including a microorganism, plant, part of the plant, or plant cell, wherein the organism has been genetically modified with a PUFA synthase that produces at least one polyunsaturated fatty acid (PUFA) and a phosphopantetheinyl transferase (PPTase), and wherein the organism contains a genetic modification to inhibit the expression or activity of a protein, e.g., a protein selected from the group consisting of KASII and KASIII, wherein the organism comprises an additional genetic modification to reduce competition for malonyl CoA with the PUFA synthase or to increase the level of malonyl CoA in the organism; wherein the organism contains an additional genetic modification to express one or more heterologous proteins from an organism that endogenously produces PUFAs; and wherein the protein utilizes PUFA-CoA as substrates in forming phospholipids (PL) or triacylglycerols (TAG); and wherein the organism comprises an additional genetic modification to delete or inactivate an endogenous fatty acid synthase (FAS) or protein associated with an FAS expressed by the organism.

In one embodiment, the invention provides a genetically modified organism, including a microorganism, plant, part of the plant, or plant cell, wherein the organism has been genetically modified with a PUFA synthase that produces at least one polyunsaturated fatty acid (PUFA) and a phosphopantetheinyl transferase (PPTase), and wherein the organism contains a genetic modification to inhibit the expression or activity of a protein, e.g., a protein selected from the group consisting of KASII and KASIII, wherein the organism comprises an additional genetic modification to reduce competition for malonyl CoA with the PUFA synthase or to increase the level of malonyl CoA in the organism; wherein the organism contains an additional genetic modification to express one or more heterologous acyl-CoA synthetases (ACoAS) or a homologue thereof that catalyzes the conversion of long chain PUFA free fatty acids (FFA) to acyl-CoA; wherein the organism contains an additional genetic modification to express one or more heterologous proteins from an organism that endogenously produces PUFAs; and wherein the protein utilizes PUFA-CoA as substrates in forming phospholipids (PL) or triacylglycerols (TAG); and wherein the organism comprises an additional genetic modification to delete or inactivate an endogenous fatty acid synthase (FAS) or protein associated with an FAS expressed by the organism.

In another embodiment, the invention provides a genetically modified organism, including a microorganism, plant, part of the plant, or plant cell, wherein the organism has been genetically modified with a PUFA synthase that produces at least one polyunsaturated fatty acid (PUFA) and a phosphopantetheinyl transferase (PPTase), and wherein at least one nucleic acid molecule encoding the PUFA synthase or the PPTase is operatively linked to a nucleic acid sequence encoding a plastid-targeting sequence, including, but not limited to that represented by SEQ ID NO:81, wherein the organism comprises an additional genetic modification to reduce competition for malonyl CoA with the PUFA synthase or to increase the level of malonyl CoA in the organism.

In another embodiment, the invention provides a genetically modified organism, including a microorganism, plant, part of the plant, or plant cell, wherein the organism has been genetically modified with a PUFA synthase that produces at least one polyunsaturated fatty acid (PUFA) and a phosphopantetheinyl transferase (PPTase), and wherein at least one nucleic acid molecule encoding the PUFA synthase or the PPTase is operatively linked to a nucleic acid sequence encoding a plastid-targeting sequence, including, but not limited to that represented by SEQ ID NO:81, wherein the organism comprises an additional genetic modification to reduce competition for malonyl CoA with the PUFA synthase or to increase the level of malonyl CoA in the organism; and wherein the organism contains an additional genetic modification to express one or more heterologous acyl-CoA synthetases (ACoAS) or a homologue thereof that catalyzes the conversion of long chain PUFA free fatty acids (FFA) to acyl-CoA.

In another embodiment, the invention provides a genetically modified organism, including a microorganism, plant, part of the plant, or plant cell, wherein the organism has been genetically modified with a PUFA synthase that produces at least one polyunsaturated fatty acid (PUFA) and a phosphopantetheinyl transferase (PPTase), and wherein at least one nucleic acid molecule encoding the PUFA synthase or the PPTase is operatively linked to a nucleic acid sequence encoding a plastid-targeting sequence including, but not limited to that represented by SEQ ID NO:81, wherein the organism comprises an additional genetic modification to reduce competition for malonyl CoA with the PUFA synthase or to increase the level of malonyl CoA in the organism; wherein the organism contains an additional genetic modification to express one or more heterologous proteins from an organism that endogenously produces PUFAs; and wherein the protein utilizes PUFA-CoA as substrates in forming phospholipids (PL) or triacylglycerols (TAG).

In another embodiment, the invention provides a genetically modified organism, including a microorganism, plant, part of the plant, or plant cell, wherein the organism has been genetically modified with a PUFA synthase that produces at least one polyunsaturated fatty acid (PUFA) and a phosphopantetheinyl transferase (PPTase), and wherein at least one nucleic acid molecule encoding the PUFA synthase or the PPTase is operatively linked to a nucleic acid sequence encoding a plastid-targeting sequence, including, but not limited to that represented by SEQ ID NO:81, wherein the organism comprises an additional genetic modification to reduce competition for malonyl CoA with the PUFA synthase or to increase the level of malonyl CoA in the organism; and wherein the organism comprises an additional genetic modification to delete or inactivate an endogenous fatty acid synthase (FAS) or protein associated with an FAS expressed by the organism.

In another embodiment, the invention provides a genetically modified organism, including a microorganism, plant, part of the plant, or plant cell, wherein the organism has been genetically modified with a PUFA synthase that produces at least one polyunsaturated fatty acid (PUFA) and a phosphopantetheinyl transferase (PPTase), and wherein at least one nucleic acid molecule encoding the PUFA synthase or the PPTase is operatively linked to a nucleic acid sequence encoding a plastid-targeting sequence, including, but not limited to that represented by SEQ ID NO:81, wherein the organism comprises an additional genetic modification to reduce competition for malonyl CoA with the PUFA synthase or to increase the level of malonyl CoA in the organism; wherein the organism contains an additional genetic modification to express one or more heterologous acyl-CoA synthetases (ACoAS) or a homologue thereof that catalyzes the conversion of long chain PUFA free fatty acids (FFA) to acyl-CoA; wherein the organism contains an additional genetic modification to express one or more heterologous proteins from an organism that endogenously produces PUFAs; and wherein the protein utilizes PUFA-CoA as substrates in forming phospholipids (PL) or triacylglycerols (TAG).

In another embodiment, the invention provides a genetically modified organism, including a microorganism, plant, part of the plant, or plant cell, wherein the organism has been genetically modified with a PUFA synthase that produces at least one polyunsaturated fatty acid (PUFA) and a phosphopantetheinyl transferase (PPTase), and wherein at least one nucleic acid molecule encoding the PUFA synthase or the PPTase is operatively linked to a nucleic acid sequence encoding a plastid-targeting sequence including, but not limited to that represented by SEQ ID NO:81, wherein the organism comprises an additional genetic modification to reduce competition for malonyl CoA with the PUFA synthase or to increase the level of malonyl CoA in the organism; wherein the organism contains an additional genetic modification to express one or more heterologous acyl-CoA synthetases (ACoAS) or a homologue thereof that catalyzes the conversion of long chain PUFA free fatty acids (FFA) to acyl-CoA; and wherein the organism comprises an additional genetic modification to delete or inactivate an endogenous fatty acid synthase (FAS) or protein associated with an FAS expressed by the organism.

In another embodiment, the invention provides a genetically modified organism, including a microorganism, plant, part of the plant, or plant cell, wherein the organism has been genetically modified with a PUFA synthase that produces at least one polyunsaturated fatty acid (PUFA) and a phosphopantetheinyl transferase (PPTase), and wherein at least one nucleic acid molecule encoding the PUFA synthase or the PPTase is operatively linked to a nucleic acid sequence encoding a plastid-targeting sequence including, but not limited to that represented by SEQ ID NO:81, wherein the organism comprises an additional genetic modification to reduce competition for malonyl CoA with the PUFA synthase or to increase the level of malonyl CoA in the organism; wherein the organism contains an additional genetic modification to express one or more heterologous proteins from an organism that endogenously produces PUFAs; and wherein the protein utilizes PUFA-CoA as substrates in forming phospholipids (PL) or triacylglycerols (TAG); and wherein the organism comprises an additional genetic modification to delete or inactivate an endogenous fatty acid synthase (FAS) or protein associated with an FAS expressed by the organism.

In another embodiment, the invention provides a genetically modified organism, including a microorganism, plant, part of the plant, or plant cell, wherein the organism has been genetically modified with a PUFA synthase that produces at least one polyunsaturated fatty acid (PUFA) and a phosphopantetheinyl transferase (PPTase), and wherein at least one nucleic acid molecule encoding the PUFA synthase or the PPTase is operatively linked to a nucleic acid sequence encoding a plastid-targeting sequence including, but not limited to that represented by SEQ ID NO:81, wherein the organism comprises an additional genetic modification to reduce competition for malonyl CoA with the PUFA synthase or to increase the level of malonyl CoA in the organism; wherein the organism contains an additional genetic modification to express one or more heterologous acyl-CoA synthetases (ACoAS) or a homologue thereof that catalyzes the conversion of long chain PUFA free fatty acids (FFA) to acyl-CoA; wherein the organism contains an additional genetic modification to express one or more heterologous proteins from an organism that endogenously produces PUFAs; and wherein the protein utilizes PUFA-CoA as substrates in forming phospholipids (PL) or triacylglycerols (TAG); and wherein the organism comprises an additional genetic modification to delete or inactivate an endogenous fatty acid synthase (FAS) or protein associated with an FAS expressed by the organism. In some embodiments, the organism contains a genetic modification to inhibit the expression or activity of one of the proteins KASII or KASIII.

In other embodiments, the organism produces an increased level of said at least one PUFA as compared to in the absence of said inhibition of KASII or KASIII.

The genetic modification can comprise the transformation of the organism with an RNAi construct that inhibits the expression or activity of KASII, or an RNAi construct that inhibits the expression or activity of KASIII. The RNAi construct can comprise a nucleic acid sequence represented herein by SEQ ID NO:122 or by SEQ ID NO:124.

In other embodiments, the genetic modification comprises the transformation of the organism with an antisense nucleic acid molecule that inhibits the expression or activity of KASII, or an antisense nucleic acid molecule that inhibits the expression or activity of KASIII. The antisense nucleic acid molecule can comprises a nucleic acid sequence represented herein by SEQ ID NO:123 or by SEQ ID NO:125.

In embodiments in which the organism contains an additional genetic modification to express one or more heterologous acyl-CoA synthetases (ACoAS) or a homologue thereof that catalyzes the conversion of long chain PUFA free fatty acids (FFA) to acyl-CoA, the organism can be transformed with a nucleic acid molecule comprising a nucleic acid sequence encoding an acyl-CoA synthetase (ACoAS) or a homologue thereof from *Crypthecodinium cohnii*, wherein the ACoAS or homologue thereof catalyzes the conversion of long chain PUFA free fatty acids (FFA) to acyl-CoA. In other embodiments, the organism is transformed with a nucleic acid molecule comprising a nucleic acid sequence encoding an acyl-CoA synthetase (ACoAS) from *Schizochytrium* or a homologue that is at least 60% identical to the amino acid sequence encoding the ACoAS from *Schizochytrium*, wherein the ACoAS or homologue thereof catalyzes the conversion of long chain PUFA free fatty acids (FFA) to acyl-CoA. In still other embodiments, the organism is transformed with a nucleic acid molecule comprising a nucleic acid sequence encoding an acyl-CoA synthetase (ACoAS) that is at least 60% identical to an ACoAS having an amino acid sequence selected from the group consisting of: SEQ ID NO:83, SEQ ID NO:85, SEQ ID NO:87, SEQ ID NO:89, SEQ ID NO:91, SEQ ID NO:93, SEQ ID NO:95, SEQ ID NO:97 and SEQ ID NO:99. In still other embodiments, the organism is transformed with a nucleic acid molecule comprising a nucleic acid sequence encoding an acyl-CoA synthetase (ACoAS) having an amino acid sequence selected from the group consisting of: SEQ ID NO:83, SEQ ID NO:85, SEQ ID NO:87, SEQ ID NO:89, SEQ ID NO:91, SEQ ID NO:93, SEQ ID NO:95, SEQ ID NO:97 and SEQ ID NO:99; and more preferably, a nucleic acid sequence encoding an acyl-CoA synthetase (ACoAS) having an amino acid sequence selected from the group consisting of: SEQ ID NO:83, SEQ ID NO:85 and SEQ ID NO:97. In yet further embodiments, the organism is transformed with a nucleic acid molecule comprising a nucleic acid sequence encoding an acyl-CoA synthetase (ACoAS) having an amino acid sequence of SEQ ID NO:83 or SEQ ID NO:85, and with a nucleic acid molecule comprising a nucleic acid sequence encoding an acyl-CoA synthetase (ACoAS) having an amino acid sequence of SEQ ID NO:97. In still further embodiments, the organism is transformed with a nucleic acid molecule comprising a nucleic acid sequence selected from the group consisting of: SEQ ID NO:82, SEQ ID NO:84, SEQ ID NO:86, SEQ ID NO:88, SEQ ID NO:90, SEQ ID NO:92, SEQ ID NO:94, SEQ ID NO:96, and SEQ ID NO:98.

In some embodiments wherein the organism contains an additional genetic modification to express one or more heterologous proteins from an organism that endogenously produces PUFAs; and wherein the protein utilizes PUFA-CoA as substrates in forming phospholipids (PL) or triacylglycerols (TAG), the organism endogenously expresses a PUFA synthase. In other embodiments, the protein is a DAGAT or an LPAAT. In other embodiments, the organism is transformed with a nucleic acid molecule comprising a nucleic acid sequence encoding a protein from a Thraustochytrid or a Labyrinthulid that utilizes PUFA-CoA as substrates in forming phospholipids (PL) or triacylglycerols (TAG). In still other embodiments, the organism is transformed with a nucleic acid molecule comprising a nucleic acid sequence encoding a protein from *Schizochytrium* that utilizes PUFA-CoA as substrates in forming phospholipids (PL) or triacylglycerols (TAG). In some embodiments, the nucleic acid sequence encodes a protein comprising an amino acid sequence that is at least 60% identical to an amino acid sequence selected from the group consisting of: SEQ ID NO:102, SEQ ID NO:104, SEQ ID NO:107, SEQ ID NO:110, and SEQ ID NO:113. In other embodiments, the organism is transformed with a nucleic acid molecule comprising a nucleic acid sequence encoding a protein comprising an amino acid sequence selected from the group consisting of: SEQ ID NO:102, SEQ ID NO:104, SEQ ID NO:107, SEQ ID NO:110, and SEQ ID NO:113; and more preferably a nucleic acid molecule comprising a nucleic acid sequence encoding a protein comprising an amino acid sequence selected from the group consisting of SEQ ID NO:102 and SEQ ID NO:104. In still other embodiments, the organism is transformed with a nucleic acid molecule comprising a nucleic acid sequence encoding a protein comprising an amino acid sequence of SEQ ID NO:102 and with a nucleic acid sequence encoding a protein comprising an amino acid sequence of SEQ ID NO:104. In other embodiments, the organism is transformed with a nucleic acid molecule comprising a nucleic acid sequence selected from the group consisting of SEQ ID NO:100, SEQ ID NO:102, SEQ ID NO:103, SEQ ID NO:105, SEQ ID NO:106, SEQ ID NO:108, SEQ ID NO:109, SEQ ID NO:111, and SEQ ID NO:112. In wherein the organism is transformed with a nucleic acid molecule comprising a nucleic acid sequence encoding a protein from *Crypthecodinium cohnii* that utilizes PUFA-CoA as substrates in forming phospholipids (PL) or triacylglycerols (TAG). In certain embodiments, the organism is transformed with a nucleic acid molecule comprising a nucleic acid sequence that is at least 90% identical to a nucleic acid sequence selected from the group consisting of: SEQ ID NO:114, SEQ ID NO:115, SEQ ID NO:116, SEQ ID NO:117, SEQ ID NO:118, SEQ ID NO:119, SEQ ID NO:120 and SEQ ID NO:121.

In some embodiments of any of the foregoing embodiments, the PUFA synthase comprises at least one functional domain from a PUFA synthase from a Thraustochytrid or a Labyrinthulid. In some embodiments, the PUFA synthase comprises at least one functional domain from a PUFA synthase from a Thraustochytriales microorganism. In other embodiments, the PUFA synthase comprises at least one functional domain from a PUFA synthase from an organism selected from the group consisting of: *Schizochytrium, Thraustochytrium, Ulkenia,* and *Labyrinthula*. In still other embodiments, the PUFA synthase comprises at least one functional domain from a PUFA synthase from an organism selected from the group consisting of *Schizochytrium* sp. American Type Culture Collection (ATCC) No. 20888, *Thraustochytrium* 23B ATCC No. 20892, and a mutant of any of these microorganisms. In some embodiments, the PUFA synthase comprises at least one functional domain from a PUFA synthase from a marine bacterium. In other embodiments, the PUFA synthase comprises at least one functional domain from a PUFA synthase from an organism selected from the group consisting of *Shewanella, Moritella* and *Photobacterium*. In still other embodiments, the PUFA synthase consists of one or more proteins comprising:

at least one enoyl-ACP reductase (ER) domain;
at least four acyl carrier protein (ACP) domains;
at least two β-ketoacyl-ACP synthase (KS) domains;
at least one acyltransferase (AT) domain;
at least one β-ketoacyl-ACP reductase (KR) domain;
at least two FabA-like β-hydroxyacyl-ACP dehydrase (DH) domains; and
at least one chain length factor (CLF) domain;
at least one malonyl-CoA:ACP acyltransferase (MAT) domain.

In further embodiments, the PUFA synthase consists of one or more proteins comprising:

two enoyl ACP-reductase (ER) domains;
eight or nine acyl carrier protein (ACP) domains;
two β-keto acyl-ACP synthase (KS) domains;
one acyltransferase (AT) domain;
one ketoreductase (KR) domain;
two FabA-like β-hydroxy acyl-ACP dehydrase (DH) domains;
one chain length factor (CLF) domain; and
one malonyl-CoA:ACP acyltransferase (MAT) domain.

In still further embodiments, the PUFA synthase is a bacterial PUFA synthase that produces PUFAs at temperatures of at least about 25° C., and wherein the PUFA synthase consists of one or more proteins comprising:

at least one enoyl ACP-reductase (ER) domain;
at least six acyl carrier protein (ACP) domains;
at least two β-keto acyl-ACP synthase (KS) domains;
at least one acyltransferase (AT) domain;
at least one ketoreductase (KR) domain;
at least two FabA-like β-hydroxy acyl-ACP dehydrase (DH) domains;
at least one chain length factor (CLF) domain;
at least one malonyl-CoA:ACP acyltransferase (MAT) domain; and
at least one 4'-phosphopantetheinyl transferase (PPTase) domain.

In some embodiments, the PUFA synthase comprises one or more sequences selected from the group consisting of: any one of SEQ ID NOs:1-32 and any one of SEQ ID NOs:35-80.

In some embodiments, one or more nucleic acid sequences encoding the PUFA synthase has been optimized to improve the expression of the PUFA synthase in the plant or plant cell. In other embodiments, expression of the PUFA synthase and the PPTase is targeted to the plastid of the plant or plant cell.

In some embodiments, the genetically modified organism is a plant and the plant is an oil seed plant. In other embodiments, the plant is a dicotyledonous plant. In still other embodiments, the plant is selected from, but is not limited to, the group consisting of: canola, soybean, rapeseed, linseed, corn, safflower, sunflower and tobacco.

In still other embodiments, the genetically modified organism produces at least one polyunsaturated fatty acid (PUFA) selected from the group consisting of: EPA (C20:5, n-3), DHA (C22:6, n-3), DPA (C22:5, n-6 or n-3), ARA (C20:4, n-6), GLA (C18:3, n-6), and/or SDA (C18:4, n-3)), and any combinations thereof. In some embodiments, the genetically modified organism produces at least one polyunsaturated fatty acid (PUFA) selected from the group consisting of: DHA, EPA and DPAn-6. In other embodiments, the genetically modified organism produces DHA and DPAn-6. In still other embodiments, the genetically modified organism produces ARA.

In some embodiments, the genetically modified organism comprises at least 0.5% by weight of said at least one PUFA. In other embodiments, the total fatty acids produced by said PUFA synthase, other than said at least one PUFA, comprises less than about 10% by weight of the total fatty acids produced by said organism. In still other embodiments, the total fatty acids produced by said PUFA synthase, other than said at least one PUFA, comprises less than about 5% by weight of the total fatty acids produced by said organism.

In still further embodiments, the total fatty acid profile in the plant, part of the plant, or plant cell comprises at least about 0.5% by weight of at least one polyunsaturated fatty acid (PUFA) having at least twenty carbons and four or more carbon-carbon double bonds, and wherein the total fatty acid profile in the plant or part of the plant contains less than 5% in total of all of the following PUFAs: gamma-linolenic acid (GLA; 18:3, n-6), PUFAs having 18 carbons and four carbon-carbon double bonds, PUFAs having 20 carbons and three carbon-carbon double bonds, and PUFAs having 22 carbons and two or three carbon-carbon double bonds.

In still further embodiments, the total fatty acid profile in the plant, part of the plant, or plant cell comprises at least about 0.5% by weight of at least one polyunsaturated fatty acid (PUFA) having at least twenty carbons and four or more carbon-carbon double bonds, and wherein the total fatty acid profile in the plant or part of the plant contains less than 1% of each of the following PUFAs: gamma-linolenic acid (GLA; 18:3, n-6), PUFAs having 18 carbons and four carbon-carbon double bonds, PUFAs having 20 carbons and three carbon-carbon double bonds, and PUFAs having 22 carbons and two or three carbon-carbon double bonds.

In yet further embodiments, the total fatty acid profile in the plant, part of the plant, or plant cell comprises at least about 0.5% by weight of at least one polyunsaturated fatty acid (PUFA) having at least twenty carbons and four or more carbon-carbon double bonds, and wherein the total fatty acid profile in the plant or part of the plant contains less than 2% of gamma-linolenic acid (GLA; 18:3, n-6) and dihomo-gamma-linolenic acid (DGLA or HGLA; 20:3, n-6).

In other embodiments, the total fatty acid profile in the genetically modified organism contains less than 1% by weight of gamma-linolenic acid (GLA; 18:3, n-6) and dihomo-gamma-linolenic acid (DGLA or HGLA; 20:3, n-6).

In other embodiments, the total fatty acid profile in the genetically modified organism comprises at least about 0.5% by weight of at least one polyunsaturated fatty acid (PUFA) having at least twenty carbons and four or more carbon-carbon double bonds, and wherein the total fatty acid profile in the plant or part of the plant contains less than 1% of gamma-linolenic acid (GLA; 18:3, n-6).

In other embodiments, the total fatty acid profile in the genetically modified organism contains less than 0.5% by weight of gamma-linolenic acid (GLA; 18:3, n-6).

The present invention also provides an oil obtained from any of the genetically modified organisms of the invention. In one embodiment, the invention provides an oil comprising detectable amounts of DHA (docosahexaenoic acid (C22:6, n-3)), and DPA (docosapentaenoic acid (C22:5, n-6), wherein the ratio of DPAn-6 to DHA is 1:1 or greater than 1:1, wherein the plant oil is obtained from any of the genetically modified organisms of the invention.

Where the genetically modified organism is a plant, the invention provides seeds obtained from the plant.

The invention also provides a food product comprising any oil or seed of the present invention.

The invention also provides a pharmaceutical product that contains an oil of the present invention.

The present invention also provides a method to produce an oil comprising at least one PUFA, comprising recovering an oil from a seed of the present invention.

The present invention also provides a method to produce an oil comprising at least one PUFA, comprising recovering an oil from any genetically modified organism of the present invention.

The present invention also provides a method to produce at least one polyunsaturated fatty acid (PUFA), comprising growing any genetically modified plant or microorganism of the present invention.

The invention further provides a method to provide a supplement or therapeutic product containing at least one PUFA to an individual, comprising providing to the individual a genetically modified organism of the present invention, seeds of the present invention, an oil of the present invention, a food product of the present invention, or a pharmaceutical product of the present invention.

The present invention also provides a method to produce the foregoing genetically modified organisms, comprising transforming a organism with one or more nucleic acid molecules encoding the PUFA synthase and the PPTase, wherein the organism contains a genetic modification to inhibit the expression or activity of a protein selected from the group consisting of KASII and KASIII.

The present invention also provides a method to produce the foregoing genetically modified organisms, comprising transforming a organism with one or more nucleic acid molecules encoding the PUFA synthase and the PPTase, and further genetically modifying the organism to inhibit the expression or activity of a protein selected from the group consisting of KASII and KASIII.

The invention also provides a process for transforming an organism to express PUFAs, comprising transforming an organism with nucleic acid molecules encoding a PUFA synthase, with a nucleic acid molecule encoding a phosphopantetheinyl transferase (PPTase), and with any of the acyl-CoA synthetase or acyltransferase described herein. In one aspect, the organism contains a genetic modification to delete or inactivate a fatty acid synthase (FAS) expressed by the organism. In one aspect, the organism contains a genetic modification to reduce competition for malonyl CoA with the PUFA synthase or to increase the level of malonyl CoA in the organism. The organism can include a plant or a microorganism, for example.

BRIEF DESCRIPTION OF THE DRAWINGS OF THE INVENTION

Figure 4:
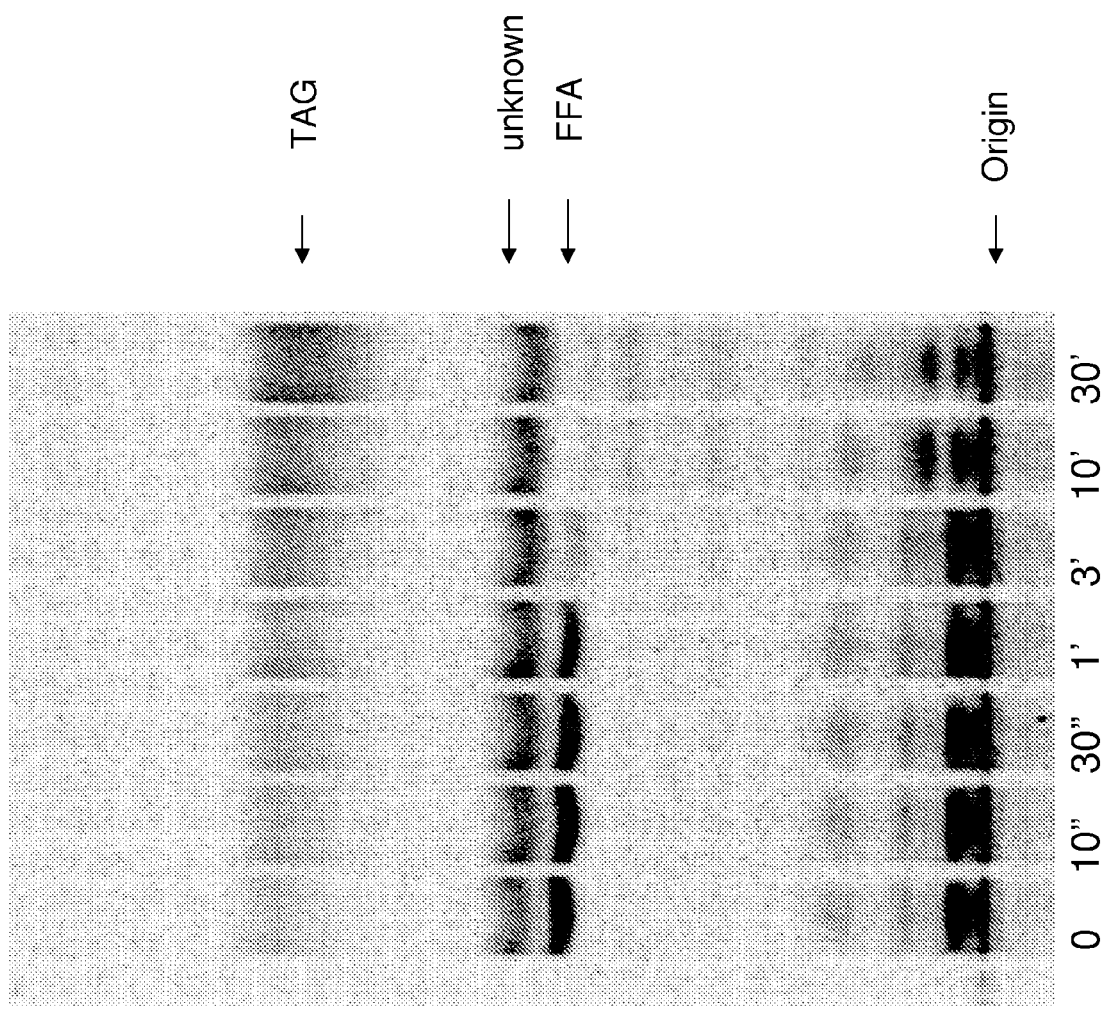

FIG. 4 is a digitized image showing the phosphorimage analysis of normal phase TLC separations of in vitro activity assays the *Schizochytrium* FAS-KO strain. Reactions were run for 10 minutes then ATP and Mg+2 were added. The reactions were stopped at the times indicated at the bottom ("=sec, '=min).

Figure 5:
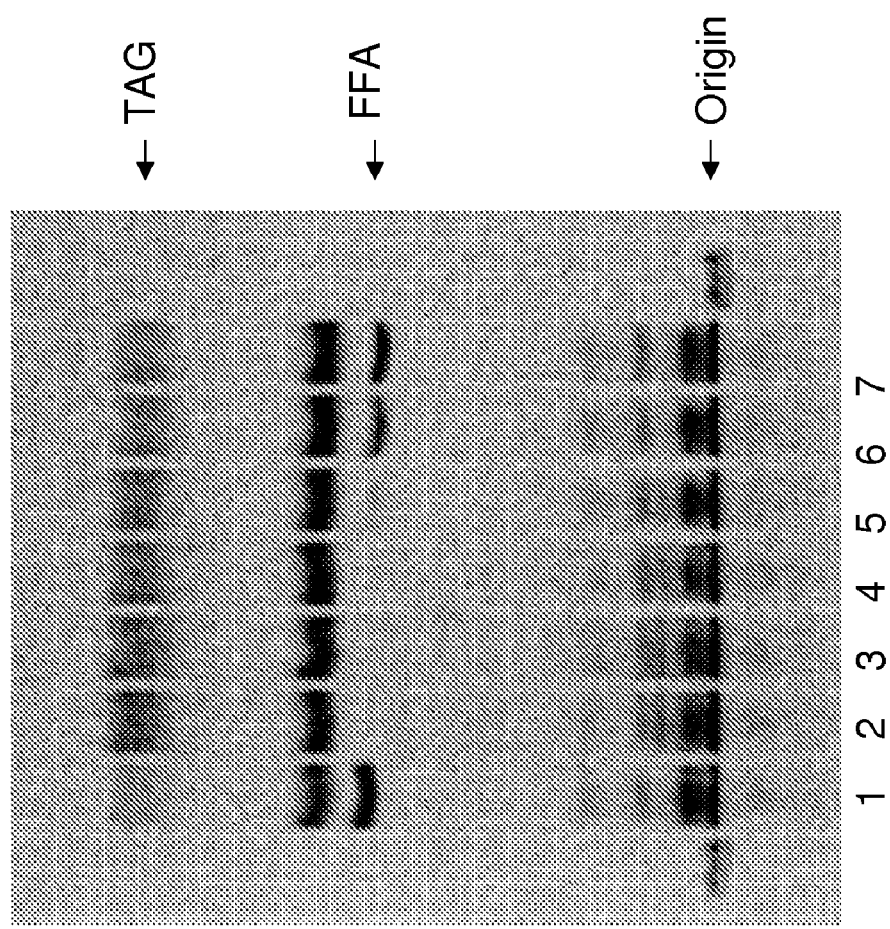

FIG. 5 is a digitized image showing the phosphorimage analysis of normal phase TLC separations of in vitro activity assays the *Schizochytrium* FAS-KO strain. Reactions were run for 10 minutes, ATP and Mg+2 were added (except in sample 1) and incubations continued for an additional 20 min (Lane 3—2 uL DMSO, Lane 4—4 uL DMSO, Lane 5—25 uM Triascin C, Lane 6—100 uM Triascin C, Lane 7—200 uM Triascin C).

FIG. 6A is a digital image showing the FAME analysis of *E. coli* expressing *Schizochytrium* OrfA, OrfB*, OrfC and Het I. Target PUFAs in the homogenate, high speed pellet fraction (P2), supernatant fraction (S1) and high speed supernatant fraction (S2) are shown.

FIG. 6B is a digital image showing the results of assays of samples of the same *E. coli* strain used for FIG. 6A, except that the lipid products were simply extracted with HIP (rather than being converted to FAMES) prior to separation by TLC.

Figure 7:
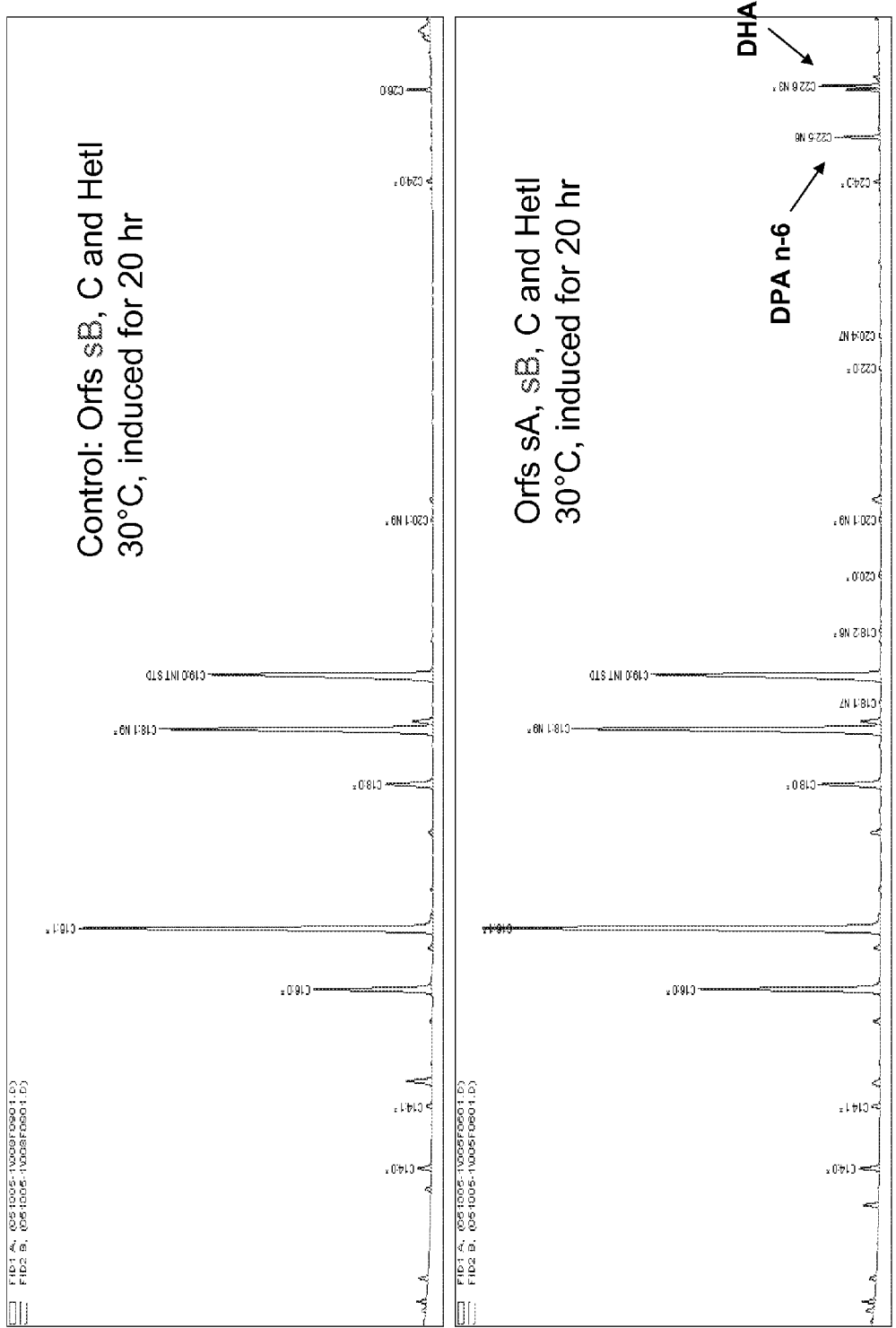

FIG. 7 is a FAME profile of control yeast and yeast expressing *Schizochytrium* OrfsA, OrfsB, OrfC and Het I.

Figure 1:
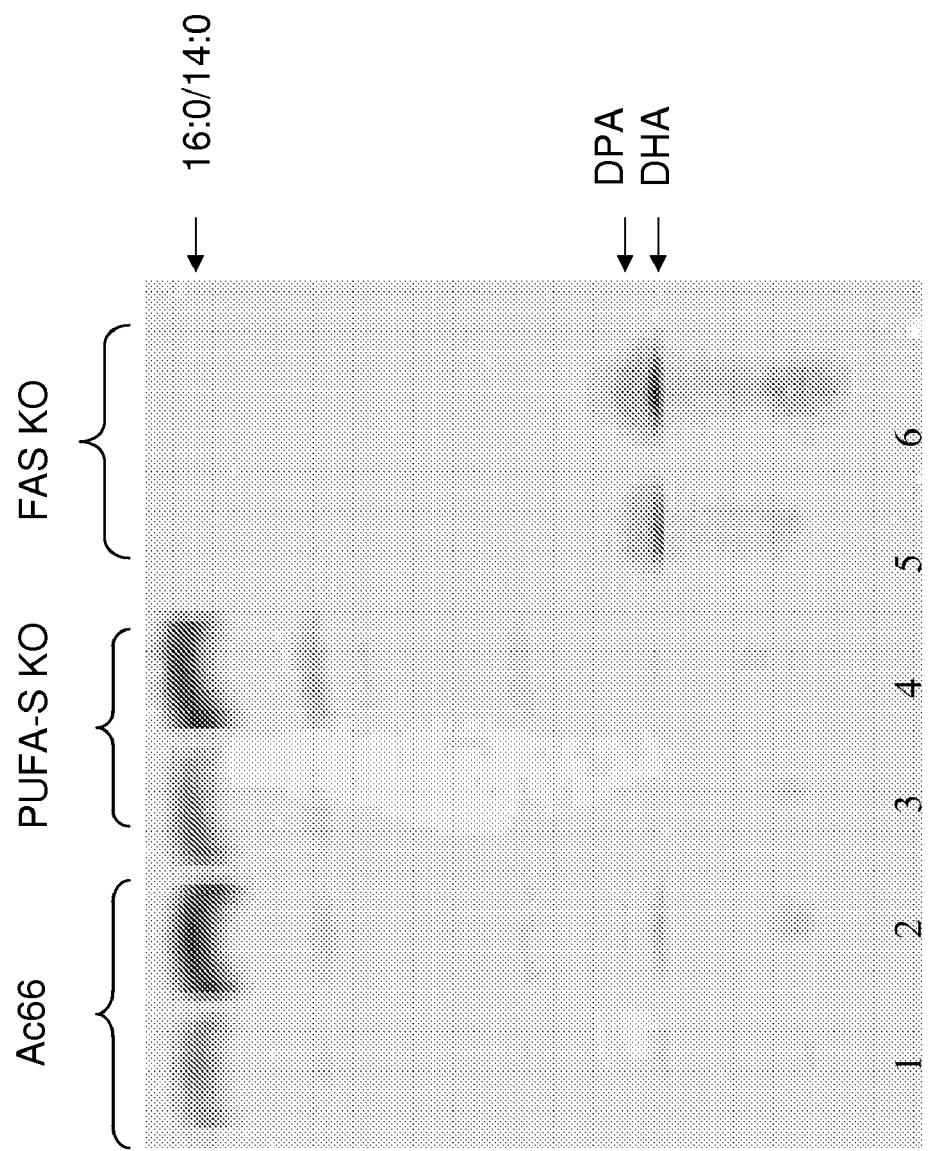
FIG. 1 is a digitized image showing a phosphorimage analysis of in vitro activity assays of cell free homogenates of *Schizochytrium* strain Ac66 and PUFA-S KO and FAS KO mutants derived from that strain.

FIG. 8 is the FAME profile for yeast from FIG. 1, expanded to illustrate the production of target PUFAs.

Figure 9:
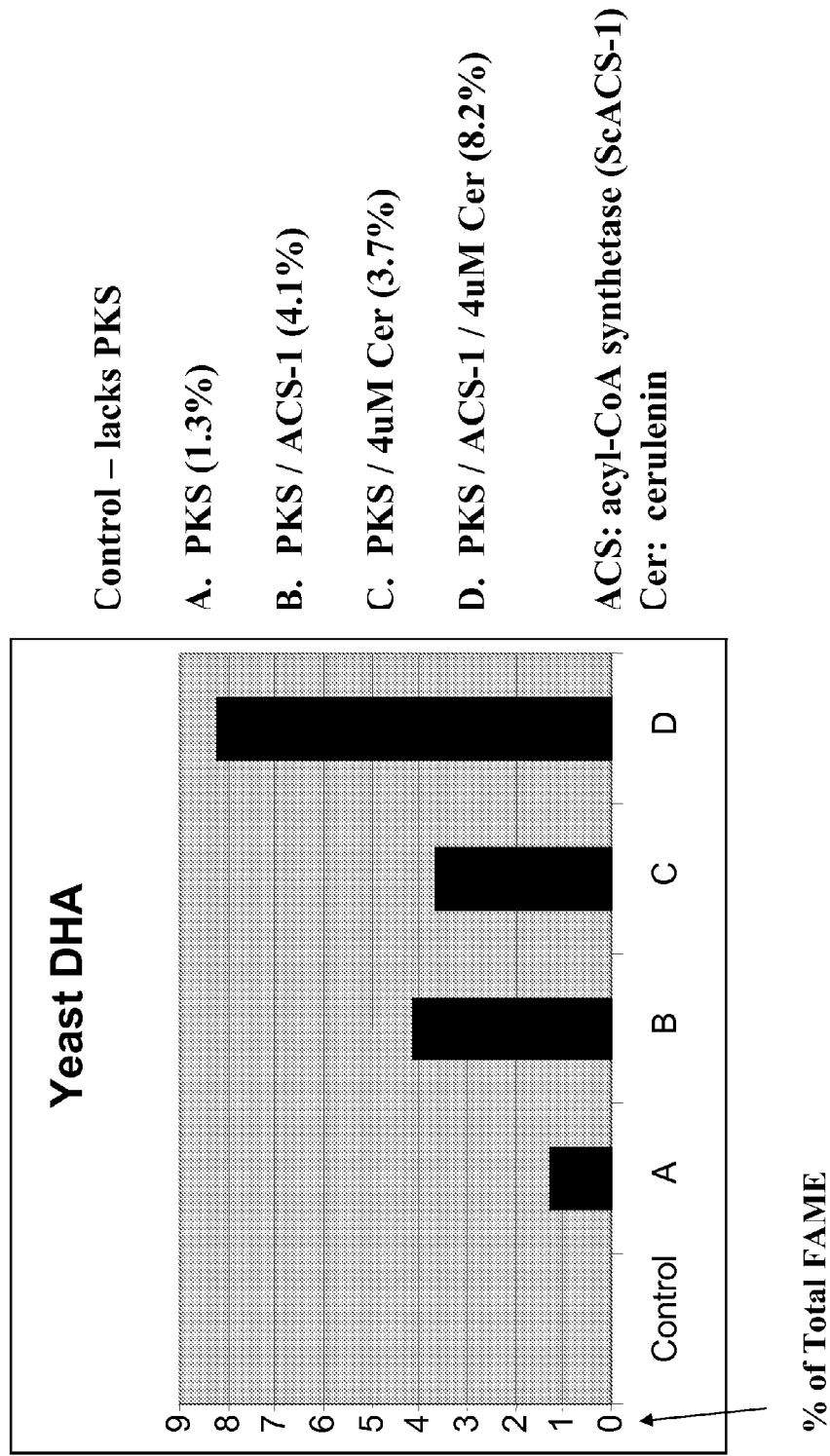

FIG. 9 is a graph showing the effects of inhibition of FAS activity on DHA profiles (as a percentage of total FAME) of yeast expressing *Schizochytrium* PUFA synthase (sOrfA, sOrfB, OrfC) and Het I, alone or in combination with expression of an acyl CoA synthetase.

Figure 10:
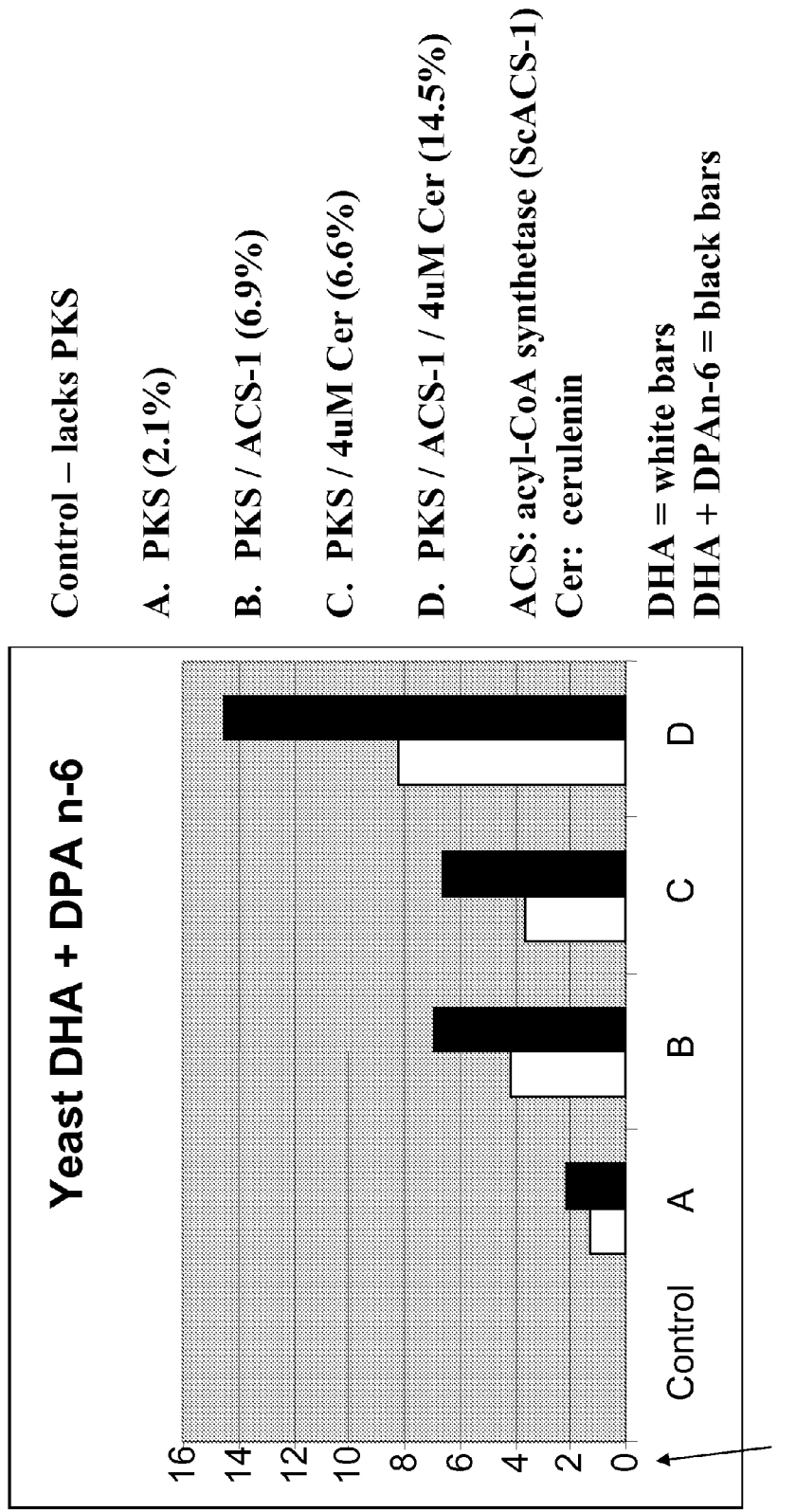

FIG. 10 is a graph showing the effects of inhibition of FAS activity on DHA and DPAn6 profiles (as a percentage of total FAME) of yeast expressing *Schizochytrium* PUFA synthase (sOrfA, sOrfB, OrfC) and Het I, alone or in combination with expression of an acyl CoA synthetase.

Figure 11:
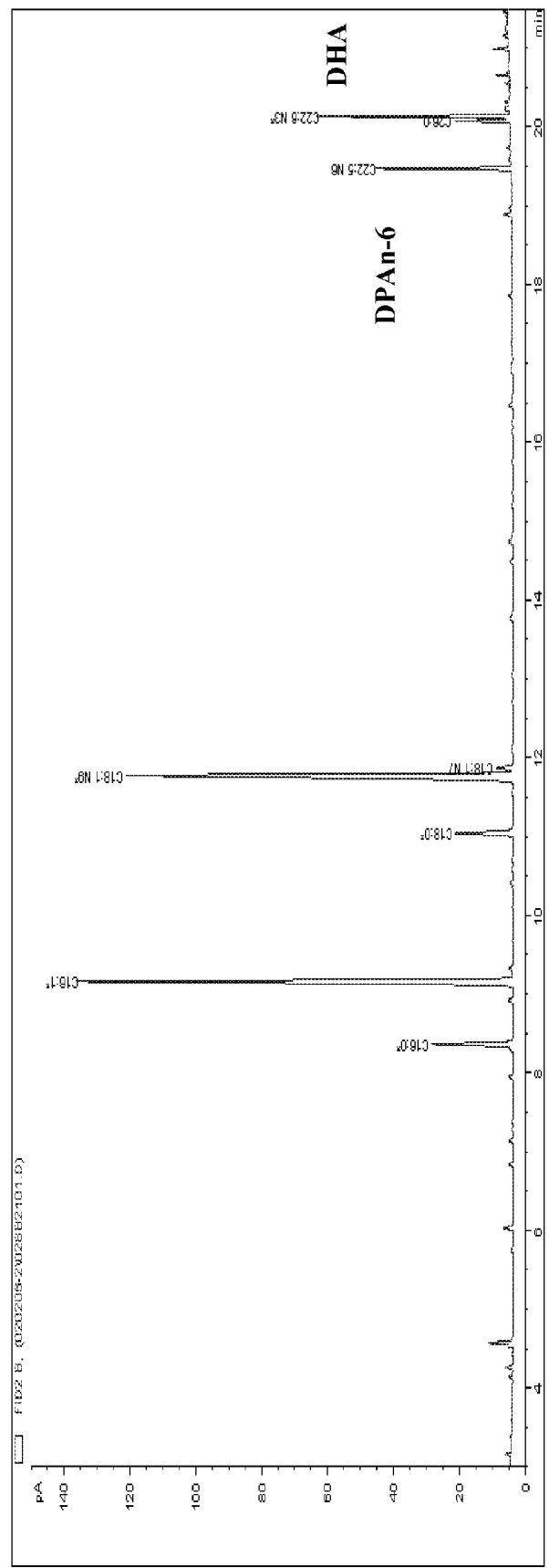

FIG. 11 is a FAME profile showing the combined effects of inhibition of FAS activity (by cerulenin), expression of *Schizochytrium* PUFA synthase (sOrfA, sOrfB, OrfC) and Het I, and expression of an acyl CoA synthetase, on DHA and DPAn6 production in yeast.

Figure 12:
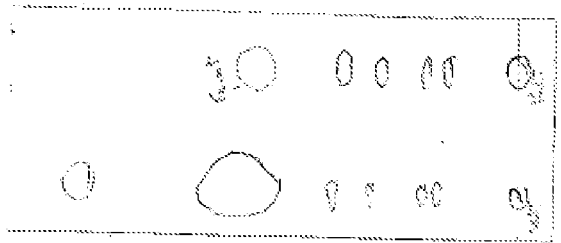

FIG. 12 shows the lipid profile from a *Schizochytrium* in which a DAGAT gene has been knocked out.

Figure 13:
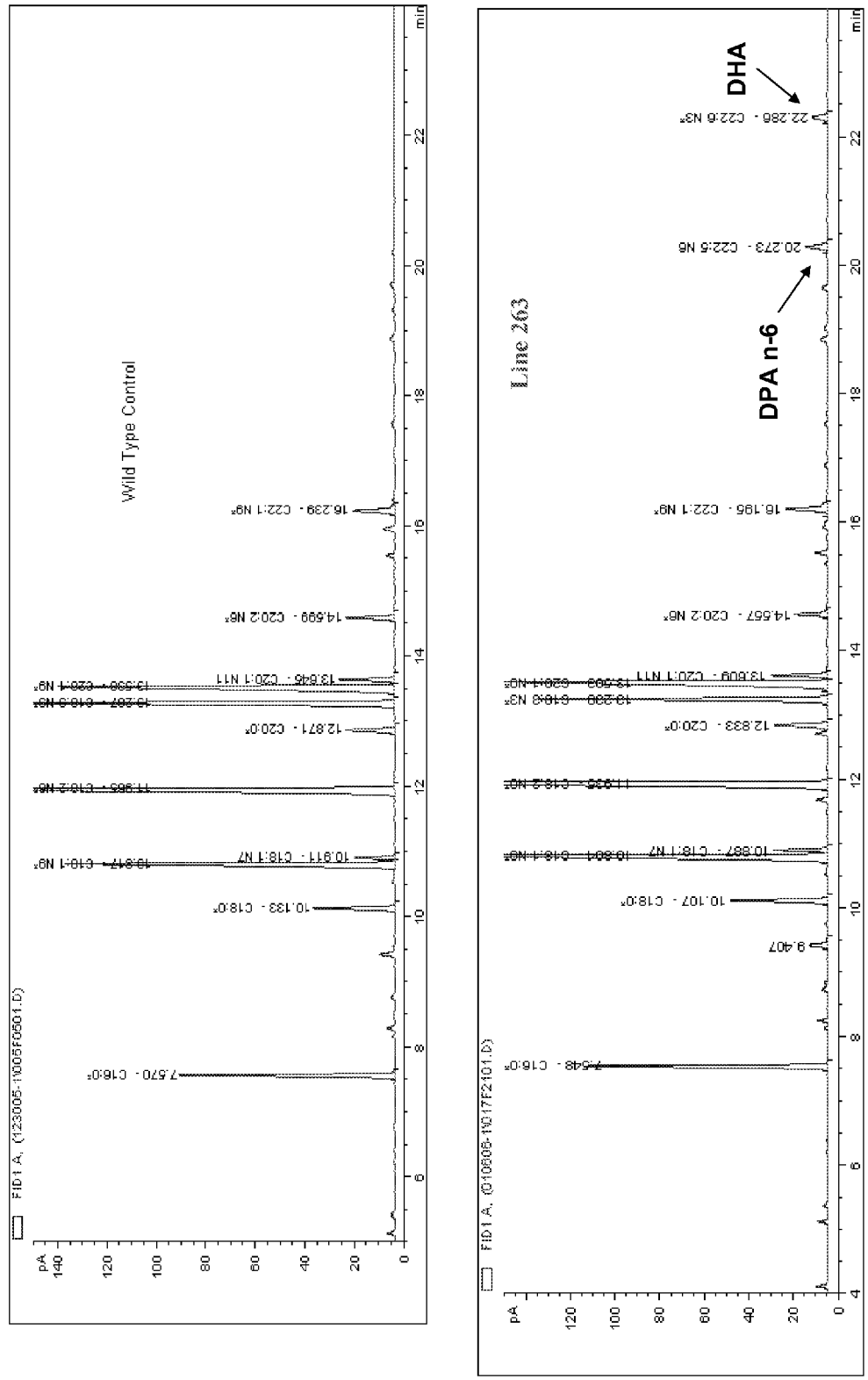

FIG. 13 is a FAME profile of wild-type *Arabidopsis* and *Arabidopsis* Line 263 (plastid targeted), expressing *Schizochytrium* Orfs A, B*, C and Het I during seed development.

Figure 14:
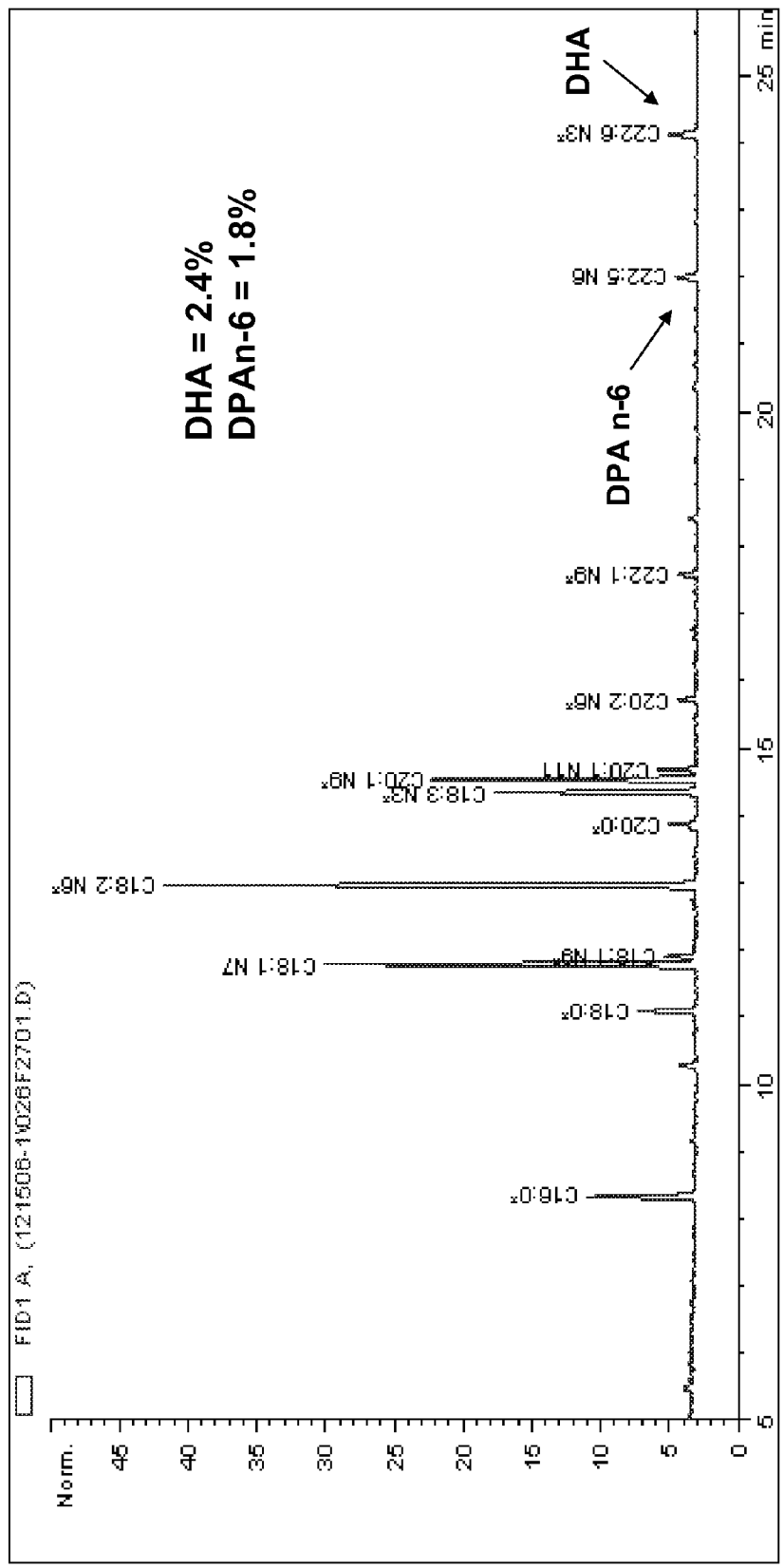

FIG. 14 is a FAME profile of an *Arabidopsis* seed from Line 1087-7 (plastid targeted), expressing *Schizochytrium* Orfs A, B*, C and HetI targeted to the plastid combined with FAS inhibition (KAS III antisense) during seed development.

Figure 15:
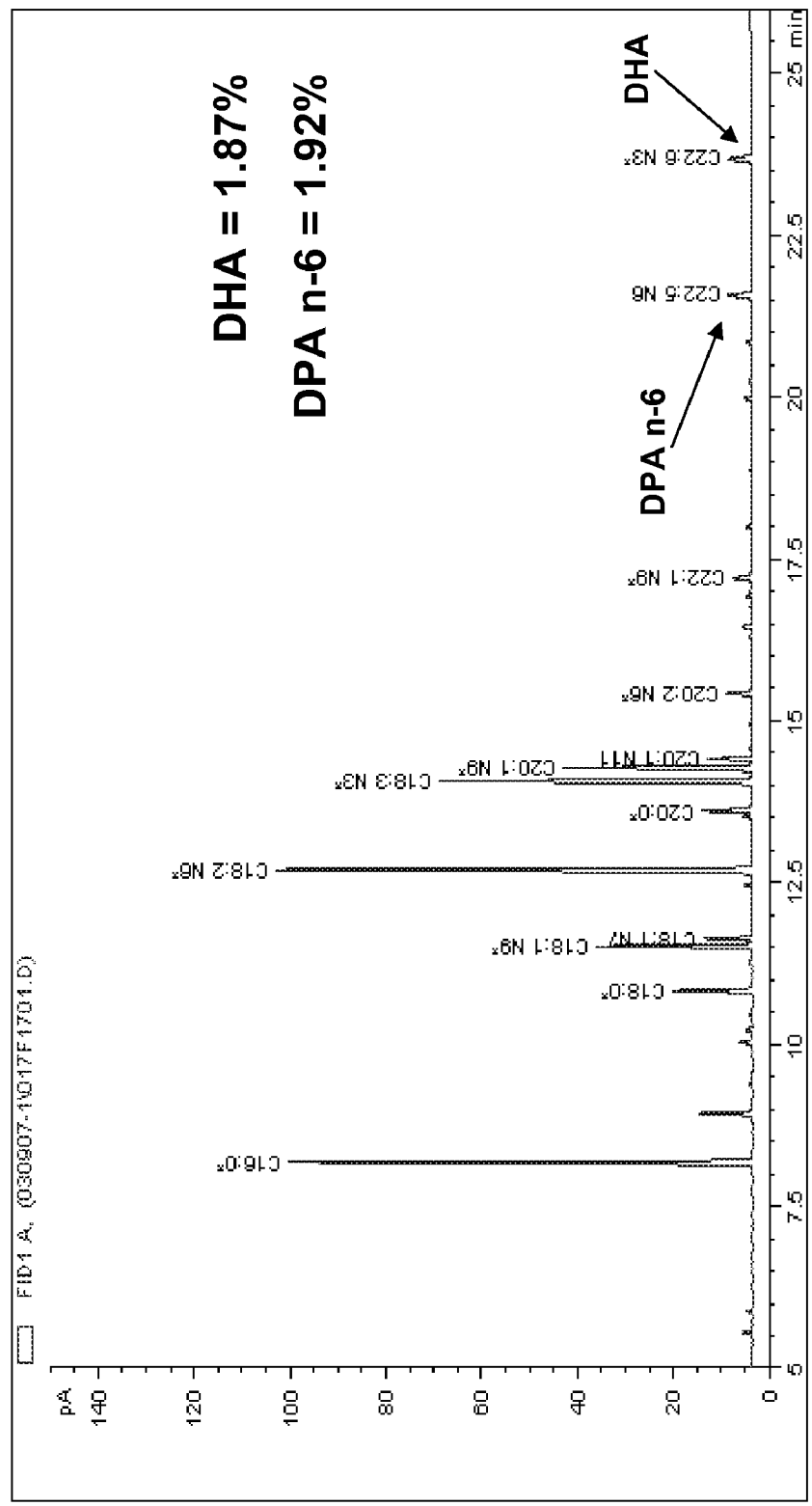

FIG. 15 is a FAME profile of pooled *Arabidopsis* seed from Line 1366 expressing *Schizochytrium* Orfs A, B*, C and HetI targeted to the plastid combined with FAS inhibition (KAS II RNAi) and ACS-1 during seed development.

DETAILED DESCRIPTION OF THE INVENTION

The present invention generally relates to the provision of proteins or targets (generally referred to herein as "accessory proteins" or "accessory targets"), and nucleic acid molecules encoding such proteins, for the improvement of the production of polyunsaturated fatty acids (PUFAs) and particularly, long chain PUFAs (LCPUFAs), in a host organism that has been genetically modified to produce such PUFAs. The present invention also relates to the organisms that have been genetically modified to express certain of such proteins, and to methods of making and using such proteins and organisms. The present invention also relates to additional genetic modifications to organisms that produce PUFAs (including by genetic modification to produce PUFAs), which can include deletions or inactivations of particular genes or targets in the organism. In particular, the present invention relates to the genetic modification of organisms that express a PUFA PKS system (either endogenously or by genetic manipulation), to improve or enhance PUFA production and/or accumulation by the organism. For example, the present invention also relates to engineering the down regulation of enzymes that compete for substrate and to the engineering of higher enzyme activities such as by mutagenesis, or targeting of enzymes to plastid organelles, as well as the cytosol.

According to the present invention, an organism that has been genetically modified to express a PUFA PKS system (also known as a PUFA synthase system, which is used interchangeably with PUFA PKS system or PKS-like system for the production of PUFAs), wherein the organism does not naturally (endogenously, without genetic modification) express such a system, or at least that particular PUFA PKS system or portion thereof with which the organism is being genetically modified, can be referred to herein as a "heterologous" host organism with regard to the modification of the organism with the PUFA PKS system or with another protein that is not endogenously expressed by the organism. The genetic modifications of the present invention may also be used to improve PUFA production in a host organism that endogenously expresses a PUFA PKS system, where the organism is not further modified with a different PUFA PKS system or a portion thereof.

More particularly, the present inventors have discovered and disclose for the first time herein that the fatty acid products of the *Schizochytrium* PUFA synthase (primarily DHA and DPAn-6) are released from that enzyme as free fatty acids (FFA), and that the release mechanism is integral to the enzyme. This product release mechanism is believed to be a characteristic of all thraustochytrid PUFA PKS (PUFA synthase) enzyme systems, and may be a characteristic of all eukaryotic PUFA PKS systems, including labyrinthulid systems. Further, the present inventors show, using *Schizochytrium* as a model, that the DHA and DPA FFAs are subsequently esterified to coenzyme A (CoA) by the action of an endogenous acyl-CoA synthetase (ACoAS or ACS) or synthetases. These activated forms of fatty acids (acyl-CoAs) can then serve as the substrates for PL and TAG forming enzymes.

The endogenous enzymes of *Schizochytrium* are very efficient in converting the FFA products of its PUFA synthase into acyl-CoA and then using those for PL and TAG synthesis. This is evidenced by the high level of DHA and DPA accumulation in *Schizochytrium* oil and PL fractions. However, without being bound by theory, the present inventors believe that the ACoAS enzymes present in heterologous hosts into which PUFA synthase systems can be transformed may not carry out those reactions as efficiently as do the ACoAS from the PUFA synthase donor organism. Additionally, the endogenous acyl-transferase enzymes which form PL and TAG in those new host organisms may not efficiently utilize PUFA-CoA as substrates, particularly as compared to the organism from which the PUFA synthase was derived. The inventors also propose that acyltransferases from certain organisms may be generally better enzymes for accumulation of PUFAs in the oil and oil fractions of host organisms, especially certain PUFAs, than similar enzymes from other organisms (e.g., an acyltransferase from one organism may transfer more DHA-CoA units into a TAG than an acyltransferase from a different organism). Therefore, the present inventors disclose herein that an organism like *Schizochytrium*, but not limited to *Schizochytrium*, (e.g., a thraustochytrid or another organism, and particularly another eukaryotic organism), which produces its PUFAs via a PUFA synthase enzyme (PUFA PKS system) or through another acyl chain biosynthesis system, and which accumulates high levels of PUFA in its PL and TAG, will serve as a good source of genes encoding those enzymes.

The discovery by the present inventors of the release of the PUFA product from the PUFA synthase as a FFA represents both challenges and opportunities in terms of transferring the system to heterologous hosts, and provides substantial opportunity to control and improve the efficiency of production of PUFAs in a heterologous host organism.

By way of explanation, long chain PUFAs (LCPUFAs) do not occur as FFAs as a part of the "standard" or "classical" PUFA biosynthetic pathway (defined below). In fact, organisms will usually only encounter a PUFA as a FFA is when it is provided exogenously. For example, *E. coli*, like most bacteria, does not synthesize PUFAs. The 16 and 18 carbon saturated or mono-unsaturated fatty acids produced by these organisms are synthesized on acyl carrier proteins (ACPs) via a Type II FAS system. The acyl-ACPs serve as substrates for the PL forming enzymes. *E. coli* can utilize a variety of FFAs as exogenous carbon sources. Those FFAs are converted to acyl-CoA prior to their entry into PLs or into a degradation cycle. The FadD gene encodes the only known ACoAS enzyme in *E. coli*, and mutations in that gene result in the inability to grow on FFAs as the sole carbon source.

Eukaryotic organisms typically produce saturated fatty acids (16 and 18 carbon) using a Type I fatty acid synthase (FAS) (or a Type II FAS in the case of higher plants). The products of the FAS system can be released as FFA (e.g. animal FAS) or as acyl-CoAs (e.g. fungal FAS). In the case of plants, the Type II FAS is localized in plastids. In this case, 16 or 18 carbon fatty acids are produced via the Type II FAS and often, a single double bond is formed while that fatty acid is attached to ACP. The acyl-ACPs can serve as substrates for formation of plastidial PL. For those fatty acids destined for export from the plastid (for use in cytoplasmic PL or for TAG synthesis), an acyl-ACP thioesterase hydrolyzes the thioester bond to release a FFA. The FFA is then exported from the plastid and converted to an acyl-CoA by a cytoplasmic ACoAS. These acyl-CoAs serve as the substrates for PL and TAG synthesis enzymes.

The "standard" or "classical" pathway for synthesis of long chain PUFAs (LCPUFAs) in eukaryotic organisms involves the modification of medium chain-length saturated or mono-unsaturated fatty acids (e.g., the products of the FAS system described above). These modifications consist of elongation steps and desaturation steps. The substrates for the elongation reaction are fatty acyl-CoA (the fatty acid chain to be elongated) and malonyl-CoA (the source of the two carbons added during each elongation reaction). The product of the elongase reaction is a fatty acyl-CoA that has two additional carbons in the linear chain. Free fatty acids (FFAs) do not normally occur in this reaction cycle. The desaturases create cis double bonds in the preexisting fatty acid chain by extraction of two hydrogens in an oxygen-dependant reaction. The substrates for the desaturases are either acyl-CoAs (in some animals) or fatty acids that are esterified to the glycerol backbone of a PL (e.g., phosphotidylcholine). Again, FFAs do not occur in this reaction mechanism. Therefore, the only time FFAs occur in "standard" or "classical" LCPUFA synthesis pathways is during release of the fatty acids from some FAS systems. As discussed above, these are typically 16 or 18 carbon fatty acids and usually are either saturated or monounsaturated fatty acids, not longer chain PUFAs such as EPA or DHA. One consequence of this scheme for long chain PUFA production is that intermediates in the pathway often accumulate, often representing the majority of the novel fatty acids produced by the system.

Therefore, according to the present invention, reference to a "standard" or "classical" pathway for the production of PUFAs refers to the fatty acid synthesis pathway where medium chain-length saturated fatty acids (e.g., products of a fatty acid synthase (FAS) system) are modified by a series of elongation and desaturation reactions. The substrates for the elongation reaction are fatty acyl-CoA (the fatty acid chain to be elongated) and malonyl-CoA (the source of the 2 carbons added during each elongation reaction). The product of the elongase reaction is a fatty acyl-CoA that has two additional carbons in the linear chain. The desaturases create cis double bonds in the preexisting fatty acid chain by extraction of 2 hydrogens in an oxygen-dependant reaction. Such pathways and the genes involved in such pathways are well-known in the literature (e.g., see Background).

The pathway for synthesis of long chain PUFAs via the PUFA PKS (PUFA synthase) enzymes (described in detail below) is very different from the "standard" pathway described above. The PUFA synthases utilize malonyl-CoA as a carbon source and produce the final PUFA without releasing intermediates in any significant amount. The appropriate cis double bonds are added during the synthesis using a mechanism that does not require oxygen. NADPH is used as a reductant during the synthesis cycles. In at least Thraustochytrid PUFA PKS systems, the enzymes release the PUFA product as a FFA, as has been disclosed for the first time by the present inventors herein. This release mechanism is part of the enzyme itself. Therefore, the release of LCPUFAs as FFA from the PUFA enzyme system is a unique feature of the PUFA PKS system of *Schizochytrium* and is likely to be a feature of all eukaryotic PUFA synthase systems such as those in thraustochytrids.

Accordingly, the present inventors propose that, when expressing a PUFA PKS system (PUFA synthase system) in a heterologous host (e.g., a host organism that does not endogenously express that particular PUFA PKS system), a factor to consider with regard to optimizing the PUFA production and accumulation in the desired compartments or lipid fractions is the ability of that host's endogenous acyl-CoA synthetase (ACoAS) enzyme(s) to recognize the FFA product of the introduced system as a substrate for conversion to the corresponding acyl-CoA. Since, as discussed above, most heterologous host organisms into which a PUFA PKS system may be introduced usually only encounter a PUFA as an FFA when it is provided exogenously, the host organism may not have optimal accessory proteins in place to handle the FFAs, which can present an inhibitory factor in the optimal production and accumulation of PUFAs in a desired lipid fraction or compartment by a host organism. For example, it is well known that there are several families of proteins that have ACoAS activity, and that the FFA substrate preferences of these enzymes can be fairly specific. Therefore, the ACoASs present in some potential hosts may not efficiently convert long chain PUFA FFA to acyl-CoA, particularly if those hosts do not normally encounter the FFA forms of those PUFA. In addition, a host organism may not have optimal acyltransferases that form PL and TAG and are able to utilize the PUFA-CoA as substrates. Finally, even in host organisms that endogenously express a PUFA PKS system, the present inventors believe that it is possible to genetically modify the organism using the modifications discussed herein to improve the accumulation of PUFAs in the oils and oil fractions in the organism.

The pathway and discoveries by the present inventors described above provides several guidelines or strategies for the production of PUFAs in heterologous (or native) hosts by expression of a PUFA synthase:

1. Gene Optimization Optimization of the genes sequences to match those of the heterologous host may be needed in order to obtain expression of the proteins. This is illustrated in the Examples described below, where genes encoding proteins from a PUFA PKS system from *Schizochytrium* are optimized for codon usage in a bacterial host as well as yeast. A gene optimized for use in bacteria was also found to be useful for expression of the *Schizochytrium* PUFA PKS in plants. Details regarding these optimized genes are described below.

2. PPTase Expression The present inventors have determined that endogenous PPTases present in *E. coli*, yeast and plants are not able to activate the PUFA synthase ACP domains. The present inventors have previously identified a suitable alternative PPTase, Het I from *Nostoc* (described in U.S. Patent Application Publication No. 20020194641), which can be used in hosts whose endogenous PPTases do not activate the PUFA synthase ACP domains. Other suitable PPTases are also described and can be readily obtained. Use of PPTases in a variety of heterologous host cells is described and exemplified below.

3. Modification of Substrate Flux/Inhibition of FAS PUFA synthases utilize malonyl-CoA as the source of carbon for elongation reactions. Malonyl-CoA is also used by FASs, cytoplasmic fatty acid elongation reactions and other enzymes (e.g., chalcone synthase). The PUFA synthase competes with these other enzyme systems for the malonyl-CoA. This indicates that one way to increase the flux through the PUFA synthase pathway would be to enhance its ability to compete for the malonyl-CoA pool(s). There are many possible ways to achieve enhanced ability to compete for this substrate. These include, but are not limited to, 1) inhibition of competing pathways, including inhibition of any elements in the FAS pathway, e.g., by reducing expression levels of enzymes or subunits involved in those pathways (e.g., by use of antisense RNA, RNAi, co-suppression, or mutations), 2) expression of the PUFA synthase in heterologous hosts in which competing pathways have been reduced or blocked (e.g., in Canola where the ability to elongate fatty acids in the cytoplasm has been blocked), and/or 3) by increasing the pool of malonyl-CoA (e.g., by expression of acetyl-CoA carboxylase). Examples of this strategy are described in more detail below and illustrated in the Examples.

4. Expression of Acyl-CoA Synthetases Enzymes present in *Schizochytrium* efficiently convert the free fatty acid products of the PUFA synthase to acyl-CoA. Enzymes present in heterologous hosts may not carry out these reactions with similar efficiency since those free fatty acids may not typically be encountered by those organisms. For example, expression of acyl-CoA synthetase enzymes that efficiently convert the free fatty acid products of the various PUFA synthases (e.g., DHA, DPA n-6, EPA, or other products) to acyl-CoA in those heterologous hosts may result in the increased ability to accumulate those products. In this regard, *Schizochytrium*, or other organisms that produce PUFAs via the PUFA synthase pathway, will serve as a good source of genes encoding those enzymes (see description and Examples below).

5. Expression of Acyltransferases and Related Enzymes Enzymes present in *Schizochytrium* efficiently utilize the acyl-CoA forms of the products of the PUFA synthase to synthesize PL and TAG molecules. Enzymes present in heterologous hosts may not carry out these reactions with similar efficiency since those PUFA-CoAs may not typically be encountered by those organisms. For example, expression of PL or TAG synthesis enzymes that efficiently integrate the acyl-CoA products of the various PUFA synthases (e.g., DHA-CoA, DPA n-6-CoA, EPA-CoA, or others) into PL or TAG molecules in those heterologous hosts may result in the increased ability to accumulate those products. In this regard, *Schizochytrium*, or other organisms that produce PUFAs via the PUFA synthase pathway, will serve as a good source of genes encoding those enzymes (see description and Examples below).

6. Organelle-Specific Expression Other methods are envisioned herein that can be utilized to increase the amount, or alter the profile, of PUFA accumulating in heterologous hosts. As one example, one can express the PUFA synthase system in separate compartments in the host, thereby accessing separate malonyl-CoA pools, which may result in increased accumulation (e.g., in the plastid and cytoplasm of plant cells). This strategy is also exemplified in the Examples below.

Accordingly, the present invention provides a solution to the potential inhibition of PUFA production and/or accumulation in heterologous host organisms and also provides a unique opportunity to control and enhance the production of PUFAs in any organism that produces PUFAs using a PUFA PKS system (either by genetic modification or endogenously). Specifically, the present invention provides various targets in the form of proteins and nucleic acid molecules encoding such proteins that can be expressed in organisms that have been genetically modified to express a PUFA PKS system, as well as other genetic modifications and strategies described herein, in order to enhance or increase the production and/or accumulation of PUFAs by the organism, particularly in desired compartments or lipid fractions in the organism. Such targets can generally be referred to herein as "accessory" targets for a PUFA PKS system. As used herein, a target can represent a nucleic acid molecule and/or its encoded protein for which expression or overexpression is desired in a host organism as described herein, as well as a target for deletion or inactivation, or even a target organelle (e.g., targeting to the plastid of a plant). In other words, a target can be element added to or any modification of an enzyme system for the production of PUFAs, and particularly a PUFA PKS system, wherein the target is identified as useful with respect to the increased or improved production and/or accumulation of fatty acids in a host organism.

PUFA PKS Systems (PUFA Synthases)

Accordingly, the present invention is directed to the provision of accessory proteins and other targets for use in connection with a PUFA PKS system. As used herein, a PUFA PKS system (which may also be referred to as a PUFA synthase system or PUFA synthase) generally has the following identifying features: (1) it produces PUFAs, and particularly, long chain PUFAs, as a natural product of the system; and (2) it comprises several multifunctional proteins assembled into a complex that conducts both iterative processing of the fatty acid chain as well non-iterative processing, including trans-cis isomerization and enoyl reduction reactions in selected cycles. In addition, the ACP domains present in the PUFA synthase enzymes require activation by attachment of a cofactor (4-phosphopantetheine). Attachment of this cofactor is carried out by phosphopantetheinyl transferases (PPTase). If the endogenous PPTases of the host organism are incapable of activating the PUFA synthase ACP domains, then it is necessary to provide a PPTase that is capable of carrying out that function. The inventors have identified the Het I enzyme of *Nostoc* sp. as an exemplary and suitable PPTase for activating PUFA synthase ACP domains. Reference to a PUFA PKS system or a PUFA synthase refers collectively to all of the genes and their encoded products that work in a complex to produce PUFAs in an organism. Therefore, the PUFA PKS system refers specifically to a PKS system for which the natural products are PUFAs.

More specifically, a PUFA PKS system as referenced herein produces polyunsaturated fatty acids (PUFAs) and particularly, long chain PUFAs (LCPUFAs), as products. For example, an organism that endogenously (naturally) contains a PUFA PKS system makes PUFAs using this system. According to the present invention, PUFAs are fatty acids with a carbon chain length of at least 16 carbons, and more preferably at least 18 carbons, and more preferably at least 20 carbons, and more preferably 22 or more carbons, with at least 3 or more double bonds, and preferably 4 or more, and more preferably 5 or more, and even more preferably 6 or more double bonds, wherein all double bonds are in the cis configuration. Reference to long chain polyunsaturated fatty acids (LCPUFAs) herein more particularly refers to fatty acids of 18 and more carbon chain length, and preferably 20 and more carbon chain length, containing 3 or more double bonds. LCPUFAs of the omega-6 series include: gamma-linolenic acid (C18:3), di-homo-gamma-linolenic acid (C20:3n-6), arachidonic acid (C20:4n-6), adrenic acid (also called docosatetraenoic acid or DTA) (C22:4n-6), and docosapentaenoic acid (C22:5n-6). The LCPUFAs of the omega-3 series include: alpha-linolenic acid (C18:3), eicosatrienoic acid (C20:3n-3), eicosatetraenoic acid (C20:4n-3), eicosapentaenoic acid (C20:5n-3), docosapentaenoic acid (C22:5n-3), and docosahexaenoic acid (C22:6n-3). The LCPUFAs also include fatty acids with greater than 22 carbons and 4 or more double bonds including but not limited to C28:8(n-3).

A PUFA PKS system according to the present invention also comprises several multifunctional proteins (and can include single function proteins, particularly for PUFA PKS systems from marine bacteria) that are assembled into a complex that conducts both iterative processing of the fatty acid chain as well non-iterative processing, including trans-cis isomerization and enoyl reduction reactions in selected cycles. These proteins can also be referred to herein as the core PUFA PKS enzyme complex or the core PUFA PKS system. The general functions of the domains and motifs contained within these proteins are individually known in the art and have been described in detail with regard to various PUFA PKS systems from marine bacteria and eukaryotic organisms (see, e.g., U.S. Pat. No. 6,140,486; U.S. Pat. No. 6,566,583; Metz et al., Science 293:290-293 (2001); U.S. Patent Application Publication No. 20020194641; U.S. Patent Application Publication No. 20040235127; U.S. Patent Application Publication No. 20050100995, and PCT Publication No. WO 2006/135866). The domains may be found as a single protein (i.e., the domain and protein are synonymous) or as one of two or more (multiple) domains in a single protein, as mentioned above.

The domain architecture of various PUFA PKS systems from marine bacteria and members of *Thraustochytrium*, and the structural and functional characteristics of genes and proteins comprising such PUFA PKS systems, have been described in detail (see, e.g., U.S. Pat. No. 6,140,486; U.S. Pat. No. 6,566,583; Metz et al., Science 293:290-293 (2001); U.S. Patent Application Publication No. 20020194641; U.S. Patent Application Publication No. 20040235127; U.S. Patent Application Publication No. 20050100995 and PCT Publication No. WO 2006/135866).

PUFA PKS systems and proteins or domains thereof that are useful in the present invention include both bacterial and non-bacterial PUFA PKS systems. A non-bacterial PUFA PKS system is a PUFA PKS system that is from or derived from an organism that is not a bacterium, such as a eukaryote or an archaebacterium. Eukaryotes are separated from prokaryotes based on the degree of differentiation of the cells, with eukaryotes being more differentiated than prokaryotes. In general, prokaryotes do not possess a nuclear membrane, do not exhibit mitosis during cell division, have only one chromosome, contain 70S ribosomes in their cytoplasm, do not possess mitochondria, endoplasmic reticulum, chloroplasts, lysosomes or Golgi apparatus, and may have flagella, which if present, contain a single fibril. In contrast, eukaryotes have a nuclear membrane, exhibit mitosis during cell division, have many chromosomes, contain 80S ribosomes in their cytoplasm, possess mitochondria, endoplasmic reticulum, chloroplasts (in algae), lysosomes and Golgi apparatus, and may have flagella, which if present, contain many fibrils. In general, bacteria are prokaryotes, while algae, fungi, protist, protozoa and higher plants are eukaryotes. According to the present invention, genetically modified plants can be produced which incorporate non-bacterial PUFA PKS functional domains with bacterial PUFA PKS functional domains, as well as PKS functional domains or proteins from other PKS systems (Type I iterative or modular, Type II, or Type III) or FAS systems.

Preferably, a PUFA PKS system of the present invention comprises at least the following biologically active domains that are typically contained on three or more proteins: (a) at least one enoyl-ACP reductase (ER) domain; (b) multiple acyl carrier protein (ACP) domain(s) (e.g., at least from one to four, and preferably at least five ACP domains, and in some embodiments up to six, seven, eight, nine, ten, or more than ten ACP domains); (c) at least two β-ketoacyl-ACP synthase (KS) domains; (d) at least one acyltransferase (AT) domain; (e) at least one β-ketoacyl-ACP reductase (KR) domain; (f) at least two FabA-like β-hydroxyacyl-ACP dehydrase (DH) domains; (g) at least one chain length factor (CLF) domain; (h) at least one malonyl-CoA:ACP acyltransferase (MAT) domain. In one embodiment, a PUFA PKS system according to the present invention also comprises at least one region containing a dehydratase (DH) conserved active site motif.

In a preferred embodiment, a PUFA PKS system comprises at least the following biologically active domains: (a) at least one enoyl-ACP reductase (ER) domain; (b) at least five acyl carrier protein (ACP) domains; (c) at least two β-ketoacyl-ACP synthase (KS) domains; (d) at least one acyltransferase (AT) domain; (e) at least one β-ketoacyl-ACP reductase (KR) domain; (f) at least two FabA-like β-hydroxyacyl-ACP dehydrase (DH) domains; (g) at least one chain length factor (CLF) domain; and (h) at least one malonyl-CoA:ACP acyltransferase (MAT) domain. In one embodiment, a PUFA PKS system according to the present invention also comprises at least one region or domain containing a dehydratase (DH) conserved active site motif that is not a part of a FabA-like DH domain. The structural and functional characteristics of each of these domains are described in detail in U.S. Patent Application Publication No. 20020194641; U.S. Patent Application Publication No. 20040235127; U.S. Patent Application Publication No. 20050100995; and PCT Publication No. WO 2006/135866.

According to the present invention, a domain or protein having 3-keto acyl-ACP synthase (KS) biological activity (function) is characterized as the enzyme that carries out the initial step of the FAS (and PKS) elongation reaction cycle. The term "β-ketoacyl-ACP synthase" can be used interchangeably with the terms "3-keto acyl-ACP synthase", "β-keto acyl-ACP synthase", and "keto-acyl ACP synthase", and similar derivatives. The acyl group destined for elongation is linked to a cysteine residue at the active site of the enzyme by a thioester bond. In the multi-step reaction, the acyl-enzyme undergoes condensation with malonyl-ACP to form -keto acyl-ACP, $CO_2$ and free enzyme. The KS plays a key role in the elongation cycle and in many systems has been shown to possess greater substrate specificity than other enzymes of the reaction cycle. For example, *E. coli* has three distinct KS enzymes—each with its own particular role in the physiology of the organism (Magnuson et al., Microbiol. Rev. 57, 522 (1993)). The two KS domains of the PUFA-PKS systems described in marine bacteria and the thraustochytrids described herein may have distinct roles in the PUFA biosynthetic reaction sequence. As a class of enzymes, KS's have been well characterized. The sequences of many verified KS genes are known, the active site motifs have been identified and the crystal structures of several have been determined. Proteins (or domains of proteins) can be readily identified as belonging to the KS family of enzymes by homology to known KS sequences.

According to the present invention, a domain or protein having malonyl-CoA:ACP acyltransferase (MAT) biological activity (function) is characterized as one that transfers the malonyl moiety from malonyl-CoA to ACP. The term "malonyl-CoA:ACP acyltransferase" can be used interchangeably with "malonyl acyltransferase" and similar derivatives. In addition to the active site motif (GxSxG), these enzymes possess an extended motif of R and Q amino acids in key positions that identifies them as MAT enzymes (e.g., in contrast to an AT domain described below). In some PKS systems (but not the PUFA PKS domain) MAT domains will preferentially load methyl- or ethyl-malonate on to the ACP group (from the corresponding CoA ester), thereby introducing branches into the linear carbon chain. MAT domains can be recognized by their homology to known MAT sequences and by their extended motif structure.

According to the present invention, a domain or protein having acyl carrier protein (ACP) biological activity (function) is characterized as being small polypeptides (typically, 80 to 100 amino acids long), that function as carriers for growing fatty acyl chains via a thioester linkage to a covalently bound co-factor of the protein. They occur as separate units or as domains within larger proteins. ACPs are converted from inactive apo-forms to functional holo-forms by transfer of the phosphopantetheinyl moiety of CoA to a highly conserved serine residue of the ACP. Acyl groups are attached to ACP by a thioester linkage at the free terminus of the phosphopantetheinyl moiety. ACPs can be identified by labeling with radioactive pantetheine and by sequence homology to known ACPs. The presence of variations of the above mentioned motif (LGIDS*) is also a signature of an ACP.

According to the present invention, a domain or protein having ketoreductase activity, also referred to as 3-ketoacyl-ACP reductase (KR) biological activity (function), is characterized as one that catalyzes the pyridine-nucleotide-dependent reduction of 3-keto acyl forms of ACP. It is the first reductive step in the de novo fatty acid biosynthesis elongation cycle and a reaction often performed in polyketide biosynthesis. The term "β-ketoacyl-ACP reductase" can be used interchangeably with the terms "ketoreductase", "3-ketoacyl-ACP reductase", "keto-acyl ACP reductase" and similar derivatives of the term. Significant sequence similarity is observed with one family of enoyl ACP reductases (ER), the other reductase of FAS (but not the ER family present in the PUFA PKS systems), and the short-chain alcohol dehydrogenase family. Pfam analysis of the PUFA PKS region indicated above reveals the homology to the short-chain alcohol dehydrogenase family in the core region. Blast analysis of the same region reveals matches in the core area to known KR enzymes as well as an extended region of homology to domains from the other characterized PUFA PKS systems.

According to the present invention, a domain or protein is referred to as a chain length factor (CLF) based on the following rationale. The CLF was originally described as characteristic of Type II (dissociated enzymes) PKS systems and was hypothesized to play a role in determining the number of elongation cycles, and hence the chain length, of the end product. CLF amino acid sequences show homology to KS domains (and are thought to form heterodimers with a KS protein), but they lack the active site cysteine. CLF's role in PKS systems has been controversial. New evidence (C. Bisang et al., *Nature* 401, 502 (1999)) suggests a role in priming (providing the initial acyl group to be elongated) the PKS systems. In this role the CLF domain is thought to decarboxylate malonate (as malonyl-ACP), thus forming an acetate group that can be transferred to the KS active site. This acetate therefore acts as the 'priming' molecule that can undergo the initial elongation (condensation) reaction. Homologues of the Type II CLF have been identified as 'loading' domains in some modular PKS systems. A domain with the sequence features of the CLF is found in all currently identified PUFA PKS systems and in each case is found as part of a multidomain protein.

An "acyltransferase" or "AT" refers to a general class of enzymes that can carry out a number of distinct acyl transfer reactions. The term "acyltransferase" can be used interchangeably with the term "acyl transferase". The AT domains identified in the PUFA PKS systems described herein show good homology one another and to domains present in all of the other PUFA PKS systems currently examined and very weak homology to some acyltransferases whose specific functions have been identified (e.g. to malonyl-CoA:ACP acyltransferase, MAT). In spite of the weak homology to MAT, this AT domain is not believed to function as a MAT because it does not possess an extended motif structure characteristic of such enzymes (see MAT domain description, above). For the purposes of this disclosure, the possible functions of the AT domain in a PUFA PKS system include, but are not limited to: transfer of the fatty acyl group from the ORFA ACP domain(s) to water (i.e. a thioesterase—releasing the fatty acyl group as a free fatty acid), transfer of a fatty acyl group to an acceptor such as CoA, transfer of the acyl group among the various ACP domains, or transfer of the fatty acyl group to a lipophilic acceptor molecule (e.g. to lysophosphadic acid).

According to the present invention, this domain has enoyl reductase (ER) biological activity. The ER enzyme reduces the trans-double bond (introduced by the DH activity) in the fatty acyl-ACP, resulting in fully saturating those carbons. The ER domain in the PUFA-PKS shows homology to a newly characterized family of ER enzymes (Heath et al., *Nature* 406, 145 (2000)). Heath and Rock identified this new class of ER enzymes by cloning a gene of interest from *Streptococcus pneumoniae*, purifying a protein expressed from that gene, and showing that it had ER activity in an in vitro assay. All of the PUFA PKS systems currently examined contain at least one domain with very high sequence homology to the *Schizochytrium* ER domain, which shows homology to the *S. pneumoniae* ER protein.

According to the present invention, a protein or domain having dehydrase or dehydratase (DH) activity catalyzes a dehydration reaction. As used generally herein, reference to DH activity typically refers to FabA-like β-hydroxyacyl-ACP dehydrase (DH) biological activity. FabA-like β-hydroxyacyl-ACP dehydrase (DH) biological activity removes HOH from a β-ketoacyl-ACP and initially produces a trans double bond in the carbon chain. The term "FabA-like β-hydroxyacyl-ACP dehydrase" can be used interchangeably with the terms "FabA-like β-hydroxy acyl-ACP dehydrase", "β-hydroxyacyl-ACP dehydrase", "dehydrase" and similar derivatives. The DH domains of the PUFA PKS systems show homology to bacterial DH enzymes associated with their FAS systems (rather than to the DH domains of other PKS systems). A subset of bacterial DH's, the FabA-like DH's, possesses cis-trans isomerase activity (Heath et al., *J. Biol. Chem.*, 271, 27795 (1996)). It is the homology to the FabA-like DH proteins that indicate that one or all of the DH domains described herein is responsible for insertion of the cis double bonds in the PUFA PKS products.

A PUFA PKS protein useful of the invention may also have dehydratase activity that is not characterized as FabA-like (e.g., the cis-trans activity described above is associated with FabA-like activity), generally referred to herein as non-FabA-like DH activity, or non-FabA-like β-hydroxyacyl-ACP dehydrase (DH) biological activity. More specifically, a conserved active site motif (~13 amino acids long: L*xxHxxxGxxxxP; e.g., illustrated by amino acids 2504-2516 of SEQ ID NO:70; *in the motif, L can also be I) is found in dehydratase domains in PKS systems (Donadio S, Katz L. Gene. 1992 Feb. 1; 111 (1):51-60). This conserved motif, also referred to herein as a dehydratase (DH) conserved active site motif or DH motif, is found in a similar region of all known PUFA-PKS sequences described to date and in the PUFA PKS sequences described herein, but it is believed that his motif has only recently been detected. This conserved motif is within an uncharacterized region of high homology in the PUFA-PKS sequence. The proposed biosynthesis of PUFAs via the PUFA-PKS requires a non-FabA like dehydration, and this motif may be responsible for the reaction.

For purposes of illustration, the structure of several PUFA PKS systems is described in detail below. However, it is to be understood that this invention is not limited to the use of these PUFA PKS systems.

*Schizochytrium* PUFA PKS System

In one embodiment, a PUFA PKS system from *Schizochytrium* comprises at least the following biologically active domains: (a) two enoyl-ACP reductase (ER) domain; (b) between five and ten or more acyl carrier protein (ACP) domains, and in one aspect, nine ACP domains; (c) two β-ketoacyl-ACP synthase (KS) domains; (d) one acyltransferase (AT) domain; (e) one β-ketoacyl-ACP reductase (KR) domain; (f) two FabA-like β-hydroxyacyl-ACP dehydrase (DH) domains; (g) one chain length factor (CLF) domain; and (h) one malonyl-CoA:ACP acyltransferase (MAT) domain. In one embodiment, a *Schizochytrium* PUFA PKS system according to the present invention also comprises at least one region or domain containing a dehydratase (DH) conserved active site motif that is not a part of a FabA-like DH domain. The structural and functional characteristics of these domains are generally individually known in the art (see, e.g., U.S. Pat. No. 6,566,583; Metz et al., *Science* 293:290-293 (2001); U.S. Patent Application Publication No. 20020194641; and PCT Publication No. WO 2006/135866).

There are three open reading frames that form the core *Schizochytrium* PUFA PKS system described previously. The domain structure of each open reading frame is as follows.

*Schizochytrium* Open Reading Frame A (OrfA):

The complete nucleotide sequence for OrfA is represented herein as SEQ ID NO:1. OrfA is a 8730 nucleotide sequence (not including the stop codon) which encodes a 2910 amino acid sequence, represented herein as SEQ ID NO:2. Within OrfA are twelve domains: (a) one β-keto acyl-ACP synthase (KS) domain; (b) one malonyl-CoA:ACP acyltransferase (MAT) domain; (c) nine acyl carrier protein (ACP) domains; and (d) one ketoreductase (KR) domain. Genomic DNA clones (plasmids) encoding OrfA from both *Schizochytrium* sp. ATCC 20888 and a daughter strain of ATCC 20888, denoted *Schizochytrium* sp., strain N230D, have been isolated and sequenced.

A genomic clone described herein as JK1126, isolated from *Schizochytrium* sp. ATCC 20888, comprises, to the best of the present inventors' knowledge, the nucleotide sequence spanning from position 1 to 8730 of SEQ ID NO:1, and encodes the corresponding amino acid sequence of SEQ ID NO:2. Genomic clone pJK1126 (denoted pJK1126 OrfA genomic clone, in the form of an *E. coli* plasmid vector containing "OrfA" gene from *Schizochytrium* ATCC 20888) was deposited with the American Type Culture Collection (ATCC), 10801 University Boulevard, Manassas, Va. 20110-2209 USA on Jun. 8, 2006, and assigned ATCC Accession No. PTA-7648. The nucleotide sequence of pJK1126 OrfA genomic clone, and the amino acid sequence encoded by this plasmid are encompassed by the present invention.

Two genomic clones described herein as pJK306 OrfA genomic clone and pJK320 OrfA genomic clone, isolated from *Schizochytrium* sp. N230D, together (overlapping clones) comprise, to the best of the present inventors' knowledge, the nucleotide sequence of SEQ ID NO:1, and encode the amino acid sequence of SEQ ID NO:2. Genomic clone pJK306 (denoted pJK306 OrfA genomic clone, in the form of an *E. coli* plasmid containing 5' portion of OrfA gene from *Schizochytrium* sp. N230D (2.2 kB overlap with pJK320)) was deposited with the American Type Culture Collection (ATCC), 10801 University Boulevard, Manassas, Va. 20110-2209 USA on Jun. 8, 2006, and assigned ATCC Accession No. PTA-7641. The nucleotide sequence of pJK306 OrfA genomic clone, and the amino acid sequence encoded by this plasmid are encompassed by the present invention. Genomic clone pJK320 (denoted pJK320 OrfA genomic clone, in the form of an *E. coli* plasmid containing 3' portion of OrfA gene from *Schizochytrium* sp. N230D (2.2 kB overlap with pJK306)) was deposited with the American Type Culture Collection (ATCC), 10801 University Boulevard, Manassas, Va. 20110-2209 USA on Jun. 8, 2006, and assigned ATCC Accession No. PTA-7644. The nucleotide sequence of pJK320 OrfA genomic clone, and the amino acid sequence encoded by this plasmid are encompassed by the present invention.

The first domain in OrfA is a KS domain, also referred to herein as ORFA-KS, and the nucleotide sequence containing the sequence encoding the ORFA-KS domain is represented herein as SEQ ID NO:7 (positions 1-1500 of SEQ ID NO:1). The amino acid sequence containing the ORFA-KS domain is represented herein as SEQ ID NO:8 (positions 1-500 of SEQ ID NO:2). It is noted that the ORFA-KS domain contains an active site motif: DXAC* (*acyl binding site $C_{215}$). Also, a characteristic motif at the end of the *Schizochytrium* KS region, GFGG, is present in this domain in SEQ ID NO:2 and accordingly, in SEQ ID NO:8.

The second domain in OrfA is a MAT domain, also referred to herein as ORFA-MAT, and the nucleotide sequence containing the sequence encoding the ORFA-MAT domain is represented herein as SEQ ID NO:9 (positions 1723-3000 of SEQ ID NO:1). The amino acid sequence containing the ORFA-MAT domain is represented herein as SEQ ID NO:10 (positions 575-1000 of SEQ ID NO:2). The MAT domain comprises an aspartate at position 93 and a histidine at position 94 (corresponding to positions 667 and 668, respectively, of SEQ ID NO:2). It is noted that the ORFA-MAT domain contains an active site motif: GHS*XG (*acyl binding site $S_{706}$), represented herein as SEQ ID NO:11.

Domains 3-11 of OrfA are nine tandem ACP domains, also referred to herein as ORFA-ACP (the first domain in the sequence is ORFA-ACP1, the second domain is ORFA-ACP2, the third domain is ORFA-ACP3, etc.). The first ACP domain, ORFA-ACP1, is contained within the nucleotide sequence spanning from about position 3343 to about position 3600 of SEQ ID NO:1 (OrfA). The nucleotide sequence containing the sequence encoding the ORFA-ACP1 domain is represented herein as SEQ ID NO:12 (positions 3343-3600 of SEQ ID NO:1). The amino acid sequence containing the first ACP domain spans from about position 1115 to about position 1200 of SEQ ID NO:2. The amino acid sequence containing the ORFA-ACP1 domain is represented herein as SEQ ID NO:13 (positions 1115-1200 of SEQ ID NO:2). It is noted that the ORFA-ACP1 domain contains an active site motif: LGIDS* (*pantetheine binding motif $S_{1157}$), represented herein by SEQ ID NO:14.

The nucleotide and amino acid sequences of all nine ACP domains are highly conserved and therefore, the sequence for each domain is not represented herein by an individual sequence identifier. However, based on the information disclosed herein, one of skill in the art can readily determine the sequence containing each of the other eight ACP domains. All nine ACP domains together span a region of OrfA of from about position 3283 to about position 6288 of SEQ ID NO:1, which corresponds to amino acid positions of from about 1095 to about 2096 of SEQ ID NO:2. The nucleotide sequence for the entire ACP region containing all nine domains is represented herein as SEQ ID NO:16. The region represented by SEQ ID NO:16 includes the linker segments between individual ACP domains. The repeat interval for the nine domains is approximately every 330 nucleotides of SEQ ID NO:16 (the actual number of amino acids measured between adjacent active site serines ranges from 104 to 116 amino acids). Each of the nine ACP domains contains a pantetheine binding motif LGIDS* (represented herein by SEQ ID NO:14), wherein S* is the pantetheine binding site serine (S). The pantetheine binding site serine (S) is located near the center of each ACP domain sequence. At each end of the ACP domain region and between each ACP domain is a region that is highly enriched for proline (P) and alanine (A), which is believed to be a linker region. For example, between ACP domains 1 and 2 is the sequence: APAPVKAAA-PAAPVASAPAPA, represented herein as SEQ ID NO:15. The locations of the active site serine residues (i.e., the pantetheine binding site) for each of the nine ACP domains, with respect to the amino acid sequence of SEQ ID NO:2, are as follows: ACP1=$S_{1157}$; ACP2=$S_{1266}$; ACP3=$S_{1377}$; ACP4=$S_{1488}$; ACP5=$S_{1604}$; ACP6=$S_{1715}$; ACP7=$S_{1819}$; ACP8=$S_{1930}$; and ACP9=$S_{2034}$. Given that the average size of an ACP domain is about 85 amino acids, excluding the linker, and about 110 amino acids including the linker, with the active site serine being approximately in the center of the domain, one of skill in the art can readily determine the positions of each of the nine ACP domains in OrfA.

Domain 12 in OrfA is a KR domain, also referred to herein as ORFA-KR, and the nucleotide sequence containing the sequence encoding the ORFA-KR domain is represented herein as SEQ ID NO:17 (positions 6598-8730 of SEQ ID NO:1). The amino acid sequence containing the ORFA-KR domain is represented herein as SEQ ID NO:18 (positions 2200-2910 of SEQ ID NO:2). Within the KR domain is a core region with homology to short chain aldehyde-dehydrogenases (KR is a member of this family). This core region spans from about position 7198 to about position 7500 of SEQ ID NO:1, which corresponds to amino acid positions 2400-2500 of SEQ ID NO:2.

*Schizochytrium* Open Reading Frame B (OrfB):

The complete nucleotide sequence for OrfB is represented herein as SEQ ID NO:3. OrfB is a 6177 nucleotide sequence (not including the stop codon) which encodes a 2059 amino acid sequence, represented herein as SEQ ID NO:4. Within OrfB are four domains: (a) one-keto acyl-ACP synthase (KS) domain; (b) one chain length factor (CLF) domain; (c) one acyl transferase (AT) domain; and, (d) one enoyl ACP-reductase (ER) domain.

Genomic DNA clones (plasmids) encoding OrfB from both *Schizochytrium* sp. ATCC 20888 and a daughter strain of ATCC 20888, denoted *Schizochytrium* sp., strain N230D, have been isolated and sequenced.

A genomic clone described herein as pJK1129, isolated from *Schizochytrium* sp. ATCC 20888, comprises, to the best of the present inventors' knowledge, the nucleotide sequence of SEQ ID NO:3, and encodes the amino acid sequence of SEQ ID NO:4. Genomic clone pJK1129 (denoted pJK1129 OrfB genomic clone, in the form of an *E. coli* plasmid vector containing "OrfB" gene from *Schizochytrium* ATCC 20888) was deposited with the American Type Culture Collection (ATCC), 10801 University Boulevard, Manassas, Va. 20110-2209 USA on Jun. 8, 2006, and assigned ATCC Accession No. PTA-7649. The nucleotide sequence of pJK1126 OrfB genomic clone, and the amino acid sequence encoded by this plasmid are encompassed by the present invention.

A genomic clone described herein as pJK324 OrfB genomic clone, isolated from *Schizochytrium* sp. N230D, comprises, to the best of the present inventors' knowledge, the nucleotide sequence of SEQ ID NO:3, and encodes the amino acid sequence of SEQ ID NO:4. Genomic clone pJK324 (denoted pJK324 OrfB genomic clone, in the form of an *E. coli* plasmid containing the OrfB gene sequence from *Schizochytrium* sp. N230D) was deposited with the American Type Culture Collection (ATCC), 10801 University Boulevard, Manassas, Va. 20110-2209 USA on Jun. 8, 2006, and assigned ATCC Accession No. PTA-7643. The nucleotide sequence of pJK324 OrfB genomic clone, and the amino acid sequence encoded by this plasmid are encompassed by the present invention.

The first domain in OrfB is a KS domain, also referred to herein as ORFB-KS, and the nucleotide sequence containing the sequence encoding the ORFB-KS domain is represented herein as SEQ ID NO:19 (positions 1-1350 of SEQ ID NO:3). The amino acid sequence containing the ORFB-KS domain is represented herein as SEQ ID NO:20 (positions 1-450 of SEQ ID NO:4). This KS domain comprises a valine at position 371 of SEQ ID NO:20 (also position 371 of SEQ ID NO:20). It is noted that the ORFB-KS domain contains an active site motif: DXAC* (*acyl binding site $C_{196}$). Also, a characteristic motif at the end of this KS region, GFGG, is present in this domain in SEQ ID NO:4 and accordingly, in SEQ ID NO:20.

The second domain in OrfB is a CLF domain, also referred to herein as ORFB-CLF, and the nucleotide sequence containing the sequence encoding the ORFB-CLF domain is represented herein as SEQ ID NO:21 (positions 1378-2700 of SEQ ID NO:3). The amino acid sequence containing the ORFB-CLF domain is represented herein as SEQ ID NO:22 (positions 460-900 of SEQ ID NO:4). It is noted that the ORFB-CLF domain contains a KS active site motif without the acyl-binding cysteine.

The third domain in OrfB is an AT domain, also referred to herein as ORFB-AT, and the nucleotide sequence containing the sequence encoding the ORFB-AT domain is represented herein as SEQ ID NO:23 (positions 2701-4200 of SEQ ID NO:3). The amino acid sequence containing the ORFB-AT domain is represented herein as SEQ ID NO:24 (positions 901-1400 of SEQ ID NO:4). It is noted that the ORFB-AT domain contains an active site motif of GxS*xG (*acyl binding site $S_{1140}$) that is characteristic of acyltransferase (AT) proteins.

The fourth domain in OrfB is an ER domain, also referred to herein as ORFB-ER, and the nucleotide sequence containing the sequence encoding the ORFB-ER domain is represented herein as SEQ ID NO:25 (positions 4648-6177 of SEQ ID NO:3). The amino acid sequence containing the ORFB-ER domain is represented herein as SEQ ID NO:26 (positions 1550-2059 of SEQ ID NO:4).

*Schizochytrium* Open Reading Frame C (OrfC):

The complete nucleotide sequence for OrfC is represented herein as SEQ ID NO:5. OrfC is a 4506 nucleotide sequence (not including the stop codon) which encodes a 1502 amino acid sequence, represented herein as SEQ ID NO:6. Within OrfC are three domains: (a) two FabA-like-hydroxy acyl-ACP dehydrase (DH) domains; and (b) one enoyl ACP-reductase (ER) domain.

Genomic DNA clones (plasmids) encoding OrfC from both *Schizochytrium* sp. ATCC 20888 and a daughter strain of ATCC 20888, denoted *Schizochytrium* sp., strain N230D, have been isolated and sequenced.

A genomic clone described herein as pJK1131, isolated from *Schizochytrium* sp. ATCC 20888, comprises, to the best of the present inventors' knowledge, the nucleotide sequence of SEQ ID NO:5, and encodes the amino acid sequence of SEQ ID NO:6. Genomic clone pJK1131 (denoted pJK1131 OrfC genomic clone, in the form of an *E. coli* plasmid vector containing "OrfC" gene from *Schizochytrium* ATCC 20888) was deposited with the American Type Culture Collection (ATCC), 10801 University Boulevard, Manassas, Va. 20110-2209 USA on Jun. 8, 2006, and assigned ATCC Accession No. PTA-7650. The nucleotide sequence of pJK1131 OrfC genomic clone, and the amino acid sequence encoded by this plasmid are encompassed by the present invention.

A genomic clone described herein as pBR002 OrfC genomic clone, isolated from *Schizochytrium* sp. N230D, comprises, to the best of the present inventors' knowledge, the nucleotide sequence of SEQ ID NO:5, and encodes the amino acid sequence of SEQ ID NO:6. Genomic clone pBR002 (denoted pBR002 OrfC genomic clone, in the form of an *E. coli* plasmid vector containing the OrfC gene sequence from *Schizochytrium* sp. N230D) was deposited with the American Type Culture Collection (ATCC), 10801 University Boulevard, Manassas, Va. 20110-2209 USA on Jun. 8, 2006, and assigned ATCC Accession No. PTA-7642. The nucleotide sequence of pBR002 OrfC genomic clone, and the amino acid sequence encoded by this plasmid are encompassed by the present invention.

The first domain in OrfC is a DH domain, also referred to herein as ORFC-DH1. This is one of two DH domains in OrfC, and therefore is designated DH1. The nucleotide sequence containing the sequence encoding the ORFC-DH1 domain is represented herein as SEQ ID NO:27 (positions 1-1350 of SEQ ID NO:5). The amino acid sequence containing the ORFC-DH1 domain is represented herein as SEQ ID NO:28 (positions 1-450 of SEQ ID NO:6).

The second domain in OrfC is a DH domain, also referred to herein as ORFC-DH2. This is the second of two DH domains in OrfC, and therefore is designated DH2. The nucleotide sequence containing the sequence encoding the ORFC-DH2 domain is represented herein as SEQ ID NO:29 (positions 1351-2847 of SEQ ID NO:5). The amino acid sequence containing the ORFC-DH2 domain is represented herein as SEQ ID NO:30 (positions 451-949 of SEQ ID NO:6). This DH domain comprises the amino acids H-G-I-A-N-P-T-F-V-H-A-P-G-K-I (positions 876-890 of SEQ ID NO:6) at positions 426-440 of SEQ ID NO:30.

The third domain in OrfC is an ER domain, also referred to herein as ORFC-ER, and the nucleotide sequence containing the sequence encoding the ORFC-ER domain is represented herein as SEQ ID NO:31 (positions 2995-4506 of SEQ ID NO:5). The amino acid sequence containing the ORFC-ER domain is represented herein as SEQ ID NO:32 (positions 999-1502 of SEQ ID NO:6).

*Thraustochytrium* PUFA PKS System

In one embodiment, a *Thraustochytrium* PUFA PKS system comprises at least the following biologically active domains: (a) two enoyl-ACP reductase (ER) domain; (b) between five and ten or more acyl carrier protein (ACP) domains, and in one aspect, eight ACP domains; (c) two β-ketoacyl-ACP synthase (KS) domains; (d) one acyltransferase (AT) domain; (e) one β-ketoacyl-ACP reductase (KR) domain; (f) two FabA-like β-hydroxyacyl-ACP dehydrase (DH) domains; (g) one chain length factor (CLF) domain; and (h) one malonyl-CoA:ACP acyltransferase (MAT) domain. In one embodiment, a *Thraustochytrium* PUFA PKS system according to the present invention also comprises at least one region or domain containing a dehydratase (DH) conserved active site motif that is not a part of a FabA-like DH domain. The structural and functional characteristics of these domains are generally individually known in the art (see, e.g., U.S. Patent Publication No. 2004035127, supra).

There are three open reading frames that form the core *Thraustochytrium* 23B PUFA PKS system described previously. The domain structure of each open reading frame is as follows.

*Thraustochytrium* 23B Open Reading Frame A (OrfA):

The complete nucleotide sequence for Th. 23B OrfA is represented herein as SEQ ID NO:38. Th. 23B OrfA is a 8433 nucleotide sequence (not including the stop codon) which encodes a 2811 amino acid sequence, represented herein as SEQ ID NO:39. SEQ ID NO:38 encodes the following domains in Th. 23B OrfA: (a) one β-ketoacyl-ACP synthase (KS) domain; (b) one malonyl-CoA:ACP acyltransferase (MAT) domain; (c) eight acyl carrier protein (ACP) domains; and (d) one β-ketoacyl-ACP reductase (KR) domain.

Two genomic clones described herein as Th23BOrfA_pBR812.1 and Th23BOrfA_pBR811 (OrfA genomic clones), isolated from *Thraustochytrium* 23B, together (overlapping clones) comprise, to the best of the present inventors' knowledge, the nucleotide sequence of SEQ ID NO:38, and encodes the amino acid sequence of SEQ ID NO:39. Genomic clone Th23BOrfA_pBR812.1 (denoted Th23BOrfA_pBR812.1 genomic clone, in the form of an *E. coli* plasmid vector containing the OrfA gene sequence from *Thraustochytrium* 23B) was deposited with the American Type Culture Collection (ATCC), 10801 University Boulevard, Manassas, Va. 20110-2209 USA on Mar. 1, 2007, and assigned ATCC Accession No. PTA-8232. The nucleotide sequence of Th23BOrfA_pBR812.1, an OrfA genomic clone, and the amino acid sequence encoded by this plasmid are encompassed by the present invention. Genomic clone Th23BOrfA₇BR811 (denoted Th23BOrfA_pBR811 genomic clone, in the form of an *E. coli* plasmid vector containing the OrfA gene sequence from *Thraustochytrium* 23B) was deposited with the American Type Culture Collection (ATCC), 10801 University Boulevard, Manassas, Va. 20110-2209 USA on Mar. 1, 2007, and assigned ATCC Accession No. PTA-8231. The nucleotide sequence of Th23BOrfA_pBR811, an OrfA genomic clone, and the amino acid sequence encoded by this plasmid are encompassed by the present invention.

The first domain in Th. 23B OrfA is a KS domain, also referred to herein as Th. 23B OrfA-KS, and is contained within the nucleotide sequence spanning from about position 1 to about position 1500 of SEQ ID NO:38, represented herein as SEQ ID NO:40. The amino acid sequence containing the Th. 23B KS domain is a region of SEQ ID NO:39 spanning from about position 1 to about position 500 of SEQ ID NO:39, represented herein as SEQ ID NO:41. This region of SEQ ID NO:39 has a Pfam match to FabB (β-ketoacyl-ACP synthase) spanning from position 1 to about position 450 of SEQ ID NO:39 (also positions 1 to about 450 of SEQ ID NO:41). It is noted that the Th. 23B OrfA-KS domain contains an active site motif: DXAC* (*acyl binding site $C_{207}$). Also, a characteristic motif at the end of the Th. 23B KS region, GFGG, is present in positions 453-456 of SEQ ID NO:39 (also positions 453-456 of SEQ ID NO:41).

The second domain in Th. 23B OrfA is a MAT domain, also referred to herein as Th. 23B OrfA-MAT, and is contained within the nucleotide sequence spanning from between about position 1503 and about position 3000 of SEQ ID NO:38, represented herein as SEQ ID NO:42. The amino acid sequence containing the Th. 23B MAT domain is a region of SEQ ID NO:39 spanning from about position 501 to about position 1000, represented herein by SEQ ID NO:43. This region of SEQ ID NO:39 has a Pfam match to FabD (malonyl-CoA:ACP acyltransferase) spanning from about position 580 to about position 900 of SEQ ID NO:39 (positions 80-400 of SEQ ID NO:43). It is noted that the Th. 23B OrfA-MAT domain contains an active site motif: GHS*XG (*acyl binding site $S_{697}$), represented by positions 695-699 of SEQ ID NO:39.

Domains 3-10 of Th. 23B OrfA are eight tandem ACP domains, also referred to herein as Th. 23B OrfA-ACP (the first domain in the sequence is OrfA-ACP1, the second domain is OrfA-ACP2, the third domain is OrfA-ACP3, etc.). The first Th. 23B ACP domain, Th. 23B OrfA-ACP1, is contained within the nucleotide sequence spanning from about position 3205 to about position 3555 of SEQ ID NO:38 (OrfA), represented herein as SEQ ID NO:44. The amino acid sequence containing the first Th. 23B ACP domain is a region of SEQ ID NO:39 spanning from about position 1069 to about position 1185 of SEQ ID NO:39, represented herein by SEQ ID NO:45.

The eight ACP domains in Th. 23B OrfA are adjacent to one another and can be identified by the presence of the phosphopantetheine binding site motif, LGXDS* (represented by SEQ ID NO:46), wherein the S* is the phosphopantetheine attachment site. The amino acid position of each of the eight S* sites, with reference to SEQ ID NO:39, are 1128 (ACP1), 1244 (ACP2), 1360 (ACP3), 1476 (ACP4), 1592 (ACP5), 1708 (ACP6), 1824 (ACP7) and 1940 (ACP8). The nucleotide and amino acid sequences of all eight Th. 23B ACP domains are highly conserved and therefore, the sequence for each domain is not represented herein by an individual sequence identifier. However, based on the information disclosed herein, one of skill in the art can readily determine the sequence containing each of the other seven ACP domains in SEQ ID NO:38 and SEQ ID NO:39.

All eight Th. 23B ACP domains together span a region of Th. 23B OrfA of from about position 3205 to about position 5994 of SEQ ID NO:38, which corresponds to amino acid positions of from about 1069 to about 1998 of SEQ ID NO:39. The nucleotide sequence for the entire ACP region containing all eight domains is represented herein as SEQ ID NO:47. SEQ ID NO:47 encodes an amino acid sequence represented herein by SEQ ID NO:48. SEQ ID NO:48 includes the linker segments between individual ACP domains. The repeat interval for the eight domains is approximately every 116 amino acids of SEQ ID NO:48, and each domain can be considered to consist of about 116 amino acids centered on the active site motif (described above).

The last domain in Th. 23B OrfA is a KR domain, also referred to herein as Th. 23B OrfA-KR, which is contained within the nucleotide sequence spanning from between about position 6001 to about position 8433 of SEQ ID NO:38, represented herein by SEQ ID NO:49. The amino acid sequence containing the Th. 23B KR domain is a region of SEQ ID NO:39 spanning from about position 2001 to about position 2811 of SEQ ID NO:39, represented herein by SEQ ID NO:50. This region of SEQ ID NO:39 has a Pfam match to FabG (β-ketoacyl-ACP reductase) spanning from about position 2300 to about 2550 of SEQ ID NO:39 (positions 300-550 of SEQ ID NO:50).

*Thraustochytrium.* 23B Open Reading Frame B (OrfB):

The complete nucleotide sequence for Th. 23B OrfB is represented herein as SEQ ID NO:51, which is a 5805 nucleotide sequence (not including the stop codon) that encodes a 1935 amino acid sequence, represented herein as SEQ ID NO:52. SEQ ID NO:51 encodes the following domains in Th. 23B OrfB: (a) one β-ketoacyl-ACP synthase (KS) domain; (b) one chain length factor (CLF) domain; (c) one acyltransferase (AT) domain; and, (d) one enoyl-ACP reductase (ER) domain.

A genomic clone described herein as Th23BOrfB_pBR800 (OrfB genomic clone), isolated from *Thraustochytrium* 23B, comprises, to the best of the present inventors' knowledge, the nucleotide sequence of SEQ ID NO:51, and encodes the amino acid sequence of SEQ ID NO:52. Genomic clone Th23BOrfB_pBR800 (denoted Th23BOrfB_pBR800 genomic clone, in the form of an *E. coli* plasmid vector containing the OrfB gene sequence from *Thraustochytrium* 23B) was deposited with the American Type Culture Collection (ATCC), 10801 University Boulevard, Manassas, Va. 20110-2209 USA on Mar. 1, 2007, and assigned ATCC Accession No. PTA-8227. The nucleotide sequence of Th23BOrfB_pBR800, an OrfB genomic clone, and the amino acid sequence encoded by this plasmid are encompassed by the present invention.

The first domain in the Th. 23B OrfB is a KS domain, also referred to herein as Th. 23B OrfB-KS, which is contained within the nucleotide sequence spanning from between about position 1 and about position 1500 of SEQ ID NO:51 (Th. 23B OrfB), represented herein as SEQ ID NO:53. The amino acid sequence containing the Th. 23B KS domain is a region of SEQ ID NO: 52 spanning from about position 1 to about position 500 of SEQ ID NO:52, represented herein as SEQ ID NO:54. This region of SEQ ID NO:52 has a Pfam match to FabB (β-ketoacyl-ACP synthase) spanning from about position 1 to about position 450 (positions 1-450 of SEQ ID NO:54). It is noted that the Th. 23B OrfB-KS domain contains an active site motif: DXAC*, where C* is the site of acyl group attachment and wherein the C* is at position 201 of SEQ ID NO:52. Also, a characteristic motif at the end of the KS region, GFGG is present in amino acid positions 434-437 of SEQ ID NO:52.

The second domain in Th. 23B OrfB is a CLF domain, also referred to herein as Th. 23B OrfB-CLF, which is contained within the nucleotide sequence spanning from between about position 1501 and about position 3000 of SEQ ID NO:51 (OrfB), represented herein as SEQ ID NO:55. The amino acid sequence containing the CLF domain is a region of SEQ ID NO: 52 spanning from about position 501 to about position 1000 of SEQ ID NO:52, represented herein as SEQ ID NO:56. This region of SEQ ID NO:52 has a Pfam match to FabB (β-ketoacyl-ACP synthase) spanning from about position 550 to about position 910 (positions 50-410 of SEQ ID NO:56). Although CLF has homology to KS proteins, it lacks an active site cysteine to which the acyl group is attached in KS proteins.

The third domain in Th. 23B OrfB is an AT domain, also referred to herein as Th. 23B OrfB-AT, which is contained within the nucleotide sequence spanning from between about position 3001 and about position 4500 of SEQ ID NO:51 (Th. 23B OrfB), represented herein as SEQ ID NO:58. The amino acid sequence containing the Th. 23B AT domain is a region of SEQ ID NO: 52 spanning from about position 1001 to about position 1500 of SEQ ID NO:52, represented herein as SEQ ID NO:58. This region of SEQ ID NO:52 has a Pfam match to FabD (malonyl-CoA:ACP acyltransferase) spanning from about position 1100 to about position 1375 (positions 100-375 of SEQ ID NO:58). Although this AT domain of the PUFA synthases has homology to MAT proteins, it lacks the extended motif of the MAT (key arginine and glutamine residues) and it is not thought to be involved in malonyl-CoA transfers. The GXS*XG motif of acyltransferases is present, with the S* being the site of acyl attachment and located at position 1123 with respect to SEQ ID NO:52.

The fourth domain in Th. 23B OrfB is an ER domain, also referred to herein as Th. 23B OrfB-ER, which is contained within the nucleotide sequence spanning from between about position 4501 and about position 5805 of SEQ ID NO:51 (OrfB), represented herein as SEQ ID NO:59. The amino acid sequence containing the Th. 23B ER domain is a region of SEQ ID NO: 52 spanning from about position 1501 to about position 1935 of SEQ ID NO:52, represented herein as SEQ ID NO:60. This region of SEQ ID NO:52 has a Pfam match to a family of dioxygenases related to 2-nitropropane dioxygenases spanning from about position 1501 to about position 1810 (positions 1-310 of SEQ ID NO:60). That this domain functions as an ER can be further predicted due to homology to a newly characterized ER enzyme from *Streptococcus pneumoniae*.

*Thraustochytrium*. 23B Open Reading Frame C (OrfC):

The complete nucleotide sequence for Th. 23B OrfC is represented herein as SEQ ID NO:61, which is a 4410 nucleotide sequence (not including the stop codon) that encodes a 1470 amino acid sequence, represented herein as SEQ ID NO:62. SEQ ID NO:61 encodes the following domains in Th. 23B OrfC: (a) two FabA-like β-hydroxyacyl-ACP dehydrase (DH) domains, both with homology to the FabA protein (an enzyme that catalyzes the synthesis of trans-2-decenoyl-ACP and the reversible isomerization of this product to cis-3-decenoyl-ACP); and (b) one enoyl-ACP reductase (ER) domain with high homology to the ER domain of *Schizochytrium* OrfB.

A genomic clone described herein as Th23BOrfC_pBR709A (OrfC genomic clone), isolated from *Thraustochytrium* 23B, comprises, to the best of the present inventors' knowledge, the nucleotide sequence of SEQ ID NO:61, and encodes the amino acid sequence of SEQ ID NO:62. Genomic clone Th23BOrfC_pBR709A (denoted Th23BOrfC_pBR709A genomic clone, in the form of an *E. coli* plasmid vector containing the OrfC gene sequence from *Thraustochytrium* 23B) was deposited with the American Type Culture Collection (ATCC), 10801 University Boulevard, Manassas, Va. 20110-2209 USA on Mar. 1, 2007, and assigned ATCC Accession No. PTA-8228. The nucleotide sequence of Th23BOrfC_pBR709A, an OrfC genomic clone, and the amino acid sequence encoded by this plasmid are encompassed by the present invention.

The first domain in Th. 23B OrfC is a DH domain, also referred to herein as Th. 23B OrfC-DH1, which is contained within the nucleotide sequence spanning from between about position 1 to about position 1500 of SEQ ID NO:61 (OrfC), represented herein as SEQ ID NO:63. The amino acid sequence containing the Th. 23B DH1 domain is a region of SEQ ID NO: 62 spanning from about position 1 to about position 500 of SEQ ID NO:62, represented herein as SEQ ID NO:64. This region of SEQ ID NO:62 has a Pfam match to FabA, as mentioned above, spanning from about position 275 to about position 400 (positions 275-400 of SEQ ID NO:64).

The second domain in Th. 23B OrfC is also a DH domain, also referred to herein as Th. 23B OrfC-DH2, which is contained within the nucleotide sequence spanning from between about position 1501 to about 3000 of SEQ ID NO:61 (OrfC), represented herein as SEQ ID NO:65. The amino acid sequence containing the Th. 23B DH2 domain is a region of SEQ ID NO: 62 spanning from about position 501 to about position 1000 of SEQ ID NO:62, represented herein as SEQ ID NO:66. This region of SEQ ID NO:62 has a Pfam match to FabA, as mentioned above, spanning from about position 800 to about position 925 (positions 300-425 of SEQ ID NO:66).

The third domain in Th. 23B OrfC is an ER domain, also referred to herein as Th. 23B OrfC-ER, which is contained within the nucleotide sequence spanning from between about position 3001 to about position 4410 of SEQ ID NO:61 (OrfC), represented herein as SEQ ID NO:67. The amino acid sequence containing the Th. 23B ER domain is a region of SEQ ID NO: 62 spanning from about position 1001 to about position 1470 of SEQ ID NO:62, represented herein as SEQ ID NO:68. This region of SEQ ID NO:62 has a Pfam match to the dioxygenases related to 2-nitropropane dioxygenases, as mentioned above, spanning from about position 1025 to about position 1320 (positions 25-320 of SEQ ID NO:68). This domain function as an ER can also be predicted due to homology to a newly characterized ER enzyme from *Streptococcus pneumoniae*.

*Shewanella japonica* PUFA PKS

There are five open reading frames that form the *Shewanella japonica* core PUFA PKS system and its PPTase described previously. The domain structure of each open reading frame is as follows.

SEQ ID NO:69 is the nucleotide sequence for *Shewanella japonica* cosmid 3F3 and is found to contain 15 ORFs. The ORFs related to the PUFA PKS system in this microorganism are characterized as follows.

pfaA (nucleotides 10491-18854 of SEQ ID NO:69) encodes PFAS A (SEQ ID NO:70), a PUFA PKS protein harboring the following domains: β-ketoacyl-synthase (KS) (nucleotides 10575-12029 of SEQ ID NO:69, amino acids 29-513 of SEQ ID NO:70); malonyl-CoA: ACP acyltransferase (MAT) (nucleotides 12366-13319 of SEQ ID NO:69, amino acids 625-943 of SEQ ID NO:70); six tandem acylcarrier proteins (ACP) domains (nucleotides 14280-16157 of SEQ ID NO:69, amino acids 1264-1889 of SEQ ID NO:70); β-ketoacyl-ACP reductase (KR) (nucleotides 17280-17684 of SEQ ID NO:69, amino acids 2264-2398 of SEQ ID NO:70); and a region of the PFAS A protein between amino acids 2399 and 2787 of SEQ ID NO:70 containing a dehydratase (DH) conserved active site motif LxxHxxxGxxxxP (amino acids 2504-2516 of SEQ ID NO:70), referred to herein as DH-motif region.

In PFAS A, a KS active site DXAC* is located at amino acids 226-229 of SEQ ID NO:70 with the C* being the site of the acyl attachment. A MAT active site, GHS*XG, is located at amino acids 721-725 of SEQ ID NO:70, with the S* being the acyl binding site. ACP active sites of LGXDS* are located at the following positions: amino acids 1296-1300, amino acids 1402-1406, amino acids 1513-1517, amino acids 1614-1618, amino acids 1728-1732, and amino acids 1843-1847 in SEQ ID NO:70, with the S* being the phosphopantetheine attachment site. Between amino acids 2399 and 2787 of SEQ ID NO:70, the PFAS A also contains the dehydratase (DH) conserved active site motif LxxHxxxGxxxxP (amino acids 2504-2516 of SEQ ID NO:70) referenced above.

pfaB (nucleotides 18851-21130 of SEQ ID NO:69) encodes PFAS B (SEQ ID NO:71), a PUFA PKS protein harboring the following domain: acyltransferase (AT) (nucleotides 19982-20902 of SEQ ID NO:69, amino acids 378-684 of SEQ ID NO:71).

In PFAS B, an active site GXS*XG motif is located at amino acids 463-467 of SEQ ID NO:71, with the S* being the site of acyl-attachment.

pfaC (nucleotides 21127-27186 of SEQ ID NO:69) encodes PFAS C (SEQ ID NO:72), a PUFA PKS protein harboring the following domains: KS (nucleotides 21139-22575 of SEQ ID NO:69, amino acids 5-483 of SEQ ID NO:72); chain length factor (CLF) (nucleotides 22591-23439 of SEQ ID NO:69, amino acids 489-771 of SEQ ID NO:72); and two FabA 3-hydroxyacyl-ACP dehydratases, referred to as DH1 (nucleotides 25408-25836 of SEQ ID NO:69, amino acids 1428-1570 of SEQ ID NO:72) and DH2 (nucleotides 26767-27183 of SEQ ID NO:69, amino acids 1881-2019 of SEQ ID NO:72).

In PFAS C, a KS active site DXAC* is located at amino acids 211-214 of SEQ ID NO:72 with the C* being the site of the acyl attachment.

pfaD (nucleotides 27197-28825 of SEQ ID NO:69) encodes the PFAS D (SEQ ID NO:73), a PUFA PKS protein harboring the following domain: an enoyl reductase (ER) (nucleotides 27446-28687 of SEQ ID NO:69, amino acids 84-497 of SEQ ID NO:73).

pfaE (nucleotides 6150-7061 of SEQ ID NO:69 on the reverse complementary strand) encodes PFAS E (SEQ ID NO:74), a 4'-phosphopantetheinyl transferase (PPTase) with the identified domain (nucleotides 6504-6944 of SEQ ID NO:69, amino acids 40-186 of SEQ ID NO:74).

*Shewanella olleyana* PUFA PKS

There are five open reading frames that form the *Shewanella olleyana* core PUFA PKS system and its PPTase described previously. The domain structure of each open reading frame is as follows.

SEQ ID NO:75 is the nucleotide sequence for *Shewanella olleyana* cosmid 9A10 and was found to contain 17 ORFs. The ORFs related to the PUFA PKS system in this microorganism are characterized as follows.

pfaA (nucleotides 17437-25743 of SEQ ID NO:75) encodes PFAS A (SEQ ID NO:76), a PUFA PKS protein harboring the following domains: β-ketoacyl-synthase (KS) (nucleotides 17521-18975 of SEQ ID NO:75, amino acids 29-513 of SEQ ID NO:76); malonyl-CoA: ACP acyltransferase (MAT) (nucleotides 19309-20265 of SEQ ID NO:75, amino acids 625-943 of SEQ ID NO:76); six tandem acyl-carrier proteins (ACP) domains (nucleotides 21259-23052 of SEQ ID NO:75, amino acids 1275-1872 of SEQ ID NO:76); β-ketoacyl-ACP reductase (KR) (nucleotides 24154-24558 of SEQ ID NO:75, amino acids 2240-2374 of SEQ ID NO:76); and a region of the PFAS A protein between amino acids 2241 and 2768 of SEQ ID NO:76 containing a dehydratase (DH) conserved active site motif LxxHxxxGxxxxP (amino acids 2480-2492 of SEQ ID NO:76), referred to herein as DH-motif region.

In PFAS A, a KS active site DXAC* is located at AA 226-229 of SEQ ID NO:76 with the C* being the site of the acyl attachment. A MAT active site, GHS*XG, is located at amino acids 721-725 of SEQ ID NO:76 with the S* being the acyl binding site. ACP active sites of LGXDS* are located at: amino acids 1307-1311, amino acids 1408-1412, amino acids 1509-1513, amino acids 1617-1621, amino acids 1721-1725, and amino acids 1826-1830 in SEQ ID NO:76, with the S* being the phosphopantetheine attachment site. Between amino acids 2241 and 2768 of SEQ ID NO:76, the PFAS A also contains the dehydratase (DH) conserved active site motif LxxHxxxGxxxxP (amino acids 2480-2492 of SEQ ID NO:76) referenced above.

pfaB (nucleotides 25740-27971 of SEQ ID NO:75) encodes PFAS B (SEQ ID NO:77), a PUFA PKS protein harboring the following domain: acyltransferase (AT) (nucleotides 26837-27848 of SEQ ID NO:75, amino acids 366-703 of SEQ ID NO:77).

In PFAS B, an active site GXS*XG motif is located at amino acids 451-455 of SEQ ID NO:77 with the S* being the site of acyl-attachment.

pfaC (nucleotides 27968-34030 of SEQ ID NO:75) encodes PFAS C (SEQ ID NO:78), a PUFA PKS protein harboring the following domains: KS (nucleotides 27995-29431 SEQ ID NO:75, amino acids 10-488 SEQ ID NO:78); chain length factor (CLF) (nucleotides 29471-30217 SEQ ID NO:75, amino acids 502-750 SEQ ID NO:78); and two FabA 3-hydroxyacyl-ACP dehydratases, referred to as DH1 (nucleotides 32258-32686 SEQ ID NO:75, amino acids 1431-1573 SEQ ID NO:78), and DH2 (nucleotides 33611-34027 of SEQ ID NO:75, amino acids 1882-2020 of SEQ ID NO:78).

In PFAS C, a KS active site DXAC* is located at amino acids 216-219 of SEQ ID NO:78 with the C* being the site of the acyl attachment.

pfaD (nucleotides 34041-35669 of SEQ ID NO:75) encodes the PFAS D (SEQ ID NO:79), a PUFA PKS protein harboring the following domain: an enoyl reductase (ER) (nucleotides 34290-35531 of SEQ ID NO:75, amino acids 84-497 of SEQ ID NO:79).

pfaE (nucleotides 13027-13899 of SEQ ID NO:75 on the reverse complementary strand) encodes PFAS E (SEQ ID NO:80), a 4'-phosphopantetheinyl transferase (PPTase) with the identified domain (nucleotides 13369-13815 of SEQ ID NO:75, amino acid 29-177 of SEQ ID NO:80).

Other PUFA PKS Sequences, Including Optimized PUFA PKS Sequences

The invention includes various optimized sequences for use in the expression of PUFA PKS systems in heterologous hosts, examples of which are provided below. One of skill in the art will be able to produce optimized sequences, in particular, sequences optimized for a preferred codon usage or better expression and function in a heterologous host.

sOrfA

SEQ ID NO:35, denoted sOrfA, represents the nucleic acid sequence encoding OrfA from *Schizochytrium* (SEQ ID NO:1) that has been resynthesized for optimized codon usage in yeast. SEQ ID NO:1 and SEQ ID NO:35 each encode SEQ ID NO:2.

sOrfB

SEQ ID NO:36, denoted sOrfB, represents the nucleic acid sequence encoding OrfB from *Schizochytrium* (SEQ ID NO:3) that has been resynthesized for optimized codon usage in yeast. SEQ ID NO:3 and SEQ ID NO:36 each encode SEQ ID NO:4.

OrfB*

SEQ ID NO:37, denoted OrfB*, represents a nucleic acid sequence encoding OrfB from *Schizochytrium* (SEQ ID NO:3) that has been resynthesized within a portion of SEQ ID NO:3 for use in plant cells, and that was derived from a very similar sequence initially developed for optimized codon usage in *E. coli*, also referred to as OrfB*. OrfB* in both forms (for *E. coli* and for plants) is identical to SEQ ID NO:3 with the exception of a resynthesized BspHI (nucleotide 4415 of SEQ ID NO:3) to a SacII fragment (unique site in SEQ ID NO:3). Both versions (*E. coli* and plant) have two other codon modifications near the start of the gene as compared with the original genomic sequence of orfB (SEQ ID NO:3). First, the fourth codon, arginine (R), was changed from CGG in the genomic sequence to CGC in orfB*. Second, the fifth codon, asparagine (N), was changed from AAT in the genomic sequence to AAC in orf B*. In order to facilitate cloning of this gene into the plant vectors to create SEQ ID NO:37, a PstI site (CTGCAG) was also engineered into the *E. coli* orfB* sequence 20 bases from the start of the gene. This change did not alter the amino acid sequence of the encoded protein. Both SEQ ID NO:37 and SEQ ID NO:3 (as well as the OrfB* form for *E. coli*) encode SEQ ID NO:4.

Accessory Proteins and Additional Targets and Strategies for Improved PUFA Production and Accumulation According to the present invention, a PUFA PKS system for production and/or accumulation of PUFAs in a heterologous host or improved production and/or accumulation of PUFAs in an endogenous host, the PUFA PKS system preferably makes use of one or more of the various targets or strategies described above for the production of PUFAs (see the six guidelines and strategies described above). These strategies include, among other things, the use of various accessory proteins, which are defined herein as proteins that are not considered to be part of the core PUFA PKS system as described above (i.e., not part of the PUFA synthase enzyme complex itself), but which may be, or are, necessary for PUFA production or at least for efficient PUFA production using the core PUFA synthase enzyme complex of the present invention. These strategies also include various genetic modifications to increase the flux of substrate, malonyl CoA, through the PUFA synthase pathway by enhancing its ability to compete for the malonyl-CoA pool(s). Variations of these embodiments of the invention are described below.

Phosphopantetheinyl Transferase (PPTase)

As discussed under the general guidelines and strategies for the production of PUFAs in a heterologous host above, in order to produce PUFAs, a PUFA PKS system must work with an accessory protein that transfers a 4'-phosphopantetheinyl moiety from coenzyme A to the acyl carrier protein (ACP) domain(s). Therefore, a PUFA PKS system can be considered to include at least one 4'-phosphopantetheinyl transferase (PPTase) domain, or such a domain can be considered to be an accessory domain or protein to the PUFA PKS system. Structural and functional characteristics of PPTases have been described in detail, for example, in U.S. Patent Application Publication No. 20020194641; U.S. Patent Application Publication No. 20040235127; and U.S. Patent Application Publication No. 20050100995.

According to the present invention, a domain or protein having 4'-phosphopantetheinyl transferase (PPTase) biological activity (function) is characterized as the enzyme that transfers a 4'-phosphopantetheinyl moiety from Coenzyme A to the acyl carrier protein (ACP). This transfer to an invariant serine reside of the ACP activates the inactive apo-form to the holo-form. In both polyketide and fatty acid synthesis, the phosphopantetheine group forms thioesters with the growing acyl chains. The PPTases are a family of enzymes that have been well characterized in fatty acid synthesis, polyketide synthesis, and non-ribosomal peptide synthesis. The sequences of many PPTases are known, and crystal structures have been determined (e.g., Reuter K, Mofid M R, Marahiel M A, Ficner R. "Crystal structure of the surfactin synthetase-activating enzyme sfp: a prototype of the 4'-phosphopantetheinyl transferase superfamily" EMBO J. 1999 Dec. 1; 18(23): 6823-31) as well as mutational analysis of amino acid residues important for activity (Mofid M R, Finking R, Essen L O, Marahiel M A. "Structure-based mutational analysis of the 4'-phosphopantetheinyl transferases Sfp from *Bacillus subtilis*: carrier protein recognition and reaction mechanism" Biochemistry. 2004 Apr. 13; 43(14):4128-36). These invariant and highly conserved amino acids in PPTases are contained within the pfaE ORFs from both *Shewanella* strains described above.

One heterologous PPTase which has been demonstrated previously to recognize the OrfA ACP domains described herein as substrates is the Het I protein of *Nostoc* sp. PCC 7120 (formerly called *Anabaena* sp. PCC 7120). Het I is present in a cluster of genes in *Nostoc* known to be responsible for the synthesis of long chain hydroxy-fatty acids that are a component of a glyco-lipid layer present in heterocysts of that organism (Black and Wolk, 1994, *J. Bacteriol.* 176, 2282-2292; Campbell et al., 1997, *Arch. Microbiol.* 167, 251-258). Het I is likely to activate the ACP domains of a protein, Hgl E, present in that cluster. The two ACP domains of Hgl E have a high degree of sequence homology to the ACP domains found in *Schizochytrium* Orf A. SEQ ID NO:34 represents the amino acid sequence of the *Nostoc* Het I protein, and is a functional PPTase that can be used with a PUFA PKS system described herein, including the PUFA PKS systems from *Schizochytrium* and *Thraustochytrium*. SEQ ID NO:34 is encoded by SEQ ID NO:33. The endogenous start codon of Het I has not been identified (there is no methionine present in the putative protein). There are several potential alternative start codons (e.g., TTG and ATT) near the 5' end of the open reading frame. No methionine codons (ATG) are present in the sequence. However, the construction of a Het I expression construct was completed using PCR to replace the furthest 5' potential alternative start codon (TTG) with a methionine codon (ATG, as part of an NdeI restriction enzyme recognition site), and introducing an XhoI site at the 3' end of the coding sequence, and the encoded PPTase (SEQ ID NO:34) has been shown to be functional.

Another heterologous PPTase which has been demonstrated previously to recognize the OrfA ACP domains described herein as substrates is sfp, derived from *Bacillus subtilis*. Sfp has been well characterized, and is widely used due to its ability to recognize a broad range of substrates. Based on published sequence information (Nakana, et al., 1992, *Molecular and General Genetics* 232: 313-321), an expression vector was previously produced for sfp by cloning the coding region, along with defined up- and downstream flanking DNA sequences, into a pACYC-184 cloning vector. This construct encodes a functional PPTase as demonstrated by its ability to be co-expressed with *Schizochytrium* Orfs A, B*, and C in *E. coli* which, under appropriate conditions, resulted in the accumulation of DHA in those cells (see U.S. Patent Application Publication No. 20040235127).

When genetically modifying organisms (e.g., microorganisms or plants) to express a PUFA PKS system according to the present invention, some host organisms may endogenously express accessory proteins that are needed to work with the PUFA PKS to produce PUFAs (e.g., PPTases). However, some organisms may be transformed with nucleic acid molecules encoding one or more accessory proteins described herein to enable and/or to enhance production of PUFAs by the organism, even if the organism endogenously produces a homologous accessory protein (i.e., some heterologous accessory proteins may operate more effectively or efficiently with the transformed PUFA synthase proteins than the host cells' endogenous accessory protein). The present invention provides an example of bacteria, yeast and plants that have been genetically modified with the PUFA PKS system of the present invention that includes an accessory PPTase.

Accordingly, one embodiment of the invention relates to a genetically modified host cell or organism (e.g., a microorganism or a plant, or cells thereof), wherein the host cell or organism has been genetically modified to express a core PUFA PKS system as described herein, and also a PPTase as described herein. Suitable PPTases are described above and are also described in the art. The PPTase may be expressed on the same or a different construct as one or more of the nucleic acid molecules encoding the core PUFA PKS protein or proteins. Both embodiments are illustrated in the Examples (see Examples 12 and 13). In one aspect, the PPTase is the *Nostoc* HetI (represented herein by SEQ ID NOs:33 and 34).

In one embodiment of the invention, PUFA production and accumulation is enhanced by reducing (inhibiting, downregulating, decreasing) the expression or activity of an endogenous PPTase expressed by a host cell or host organism (e.g., to avoid competition with the PPTase introduced with the PUFA PKS enzymes according to this embodiment). Inhibition of endogenous PPTase activity can be achieved by any suitable method of deletion or inactivation of genes, including, but not limited to, use of antisense RNA, RNAi, co-suppression, or introduction of mutations).

The invention includes the expression of exogenous PPTases (alone or in combination with inhibition of endogenous PPTases) in conjunction with expression of a PUFA synthase as described herein, which are utilized alone or in combination with any one or more strategies described herein (e.g., any one, two, three, four or five of: codon optimization, organelle-targeting, enhancement of PUFA synthase competition for malonyl CoA (e.g., by inhibition of FAS), expression of an acyl CoA synthetase, and/or expression of one or more acyltransferases or related enzymes), to increase PUFA production and/or accumulation in a heterologous host.

Modification of Malonyl CoA Flux/Inhibition of FAS

As discussed above, the substrate for the PUFA PKS system (PUFA synthase), malonyl-CoA, is also used by fatty acid synthase systems (FASs), cytoplasmic fatty acid elongation reactions and other enzymes (e.g., chalcone synthase). Therefore, the PUFA synthase competes with these other enzyme systems for the malonyl-CoA. Accordingly, one embodiment of the invention relates to methods and genetic modifications to increase the flux of malonyl CoA through the PUFA synthase pathway by enhancing the ability of PUFA synthase enzymes to compete for the malonyl-CoA pool(s). Methods proposed herein include, but are not limited to, 1) inhibition of competing pathways, including inhibition of any elements in the FAS pathway, e.g., by reducing expression levels of enzymes or subunits involved in those pathways (e.g., by use of antisense RNA, RNAi, co-suppression, or mutations), 2) expression of the PUFA synthase in heterologous hosts in which competing pathways have been reduced or blocked (e.g., in Canola where the ability to elongate fatty acids in the cytoplasm has been blocked), and/or 3) by increasing the pool of malonyl-CoA (e.g., by expression of acetyl-CoA carboxylase).

More specifically, in one aspect, the present invention also includes the genetic modification of host organisms that produce PUFAs, and particularly host organisms that express a heterologous PUFA PKS system, to delete or inactivate gene(s), or to reduce the level of activity of enzymes encoded by those genes, that may compete with or interfere with PUFA production and/or accumulation by the PUFA PKS system. For example, the present inventors have found that by reducing the FAS activity in a host organism that has been transformed with a PUFA PKS system, PUFA production and accumulation improves as compared to host organisms that retain the normal level of FAS activity (see exemplary experiments in *Schizochytrium*, as well as experiments detailed for yeast and plants in the Examples).

In one embodiment, various enzymes that inhibit the production of fatty acids through the FAS pathway is envisioned. Many enzymes can be suitable targets for this embodiment of the invention, and two particularly useful targets are exemplified and described in detail below. The inventors have demonstrated the ability to knock out an FAS enzyme in *Schizochytrium* (see Examples), and this strategy can be applied to heterologous hosts. In another embodiment, the inventors have demonstrated the ability to inhibit the FAS system by biochemical methods in a yeast host, resulting in improved PUFA production in yeast expressing a PUFA synthase and a PPTase, as compared to in the absence of the biochemical targeting of the FAS system. Certain other hosts may be amenable to similar strategies.

Finally, in plants, the present inventors have demonstrated that inhibition of the FAS pathway by inhibition of KasII or KasIII using antisense or RNAi technology improves PUFA production in heterologous hosts expressing a PUFA synthase and a PPTase. While the invention is not limited to these particular targets, it is one aspect of the invention to target one or both of these enzymes for inhibition in conjunction with expression of a PUFA synthase and PPTase as described herein, alone or in combination with other strategies described herein (e.g., codon optimization, organelle-targeting, expression of an acyl CoA synthetase, and/or expression of one or more acyltransferases or related enzymes), to increase PUFA production and/or accumulation in a heterologous host.

In seeds the lipids, mainly in the form of triacylglycerols (TAGs), are derived from assimilates through an elaborate enzymatic pathway. Generally, reduced carbon is delivered to the seed via the phloem from other parts of the plant. In plant seeds the biosynthesis of TAGs is carried out intracellularly within different organelles (Ohrolgge and Browse, 1995, Plant Cell 7: 957-970). Within the plastids, short carbon precursors are converted to long chain fatty acids by the Type II soluble fatty acid synthase (FAS) complex (Slabas and Fawcett, 1992, Plant Molecular Biology 19: 169-191), which reiteratively adds C2-units to a fatty acyl chain and prepares the chain for the next round of elongation. The condensation of eight or nine rounds of C2-units yields the C16 and C18 fatty acids that characterize membrane lipids. The initial FAS activity is performed by the nuclear encoded, plastid targeted enzyme malonyl-CoA:ACP transacylase (MCAT), which transfers the malonyl group from malonyl-CoA to acyl carrier protein (ACP) (Yasuno et al., 2004, Journal of Biological Chemistry 292: 8242-8251). This forms the substrate, malonyl-ACP, which provides the C2-units for subsequent elongation. The next step in the synthesis is achieved through the catalytic activity of the nuclear encoded, plastid targeted β-ketoacyl-acyl carrier protein synthetase III (KAS III), in which the condensation of malonyl-CoA to the donor, malonyl-ACP, results in butyryl (C4)-ACP. All subsequent extensions of the ACP-activated acyl chains is carried out by the nuclear encoded, plastid targeted 3-ketoacyl-acyl carrier protein synthetase I (KAS I) and β-ketoacyl-acyl carrier protein synthetase II (KAS II) isozymes. KAS I catalyzes the condensation reactions converting C4-ACP to C16-ACP by utilizing butyryl (C4)- to myristoyl (C14)-ACPs as substrates, and KAS II is performs the last step to yield stearoyl (C18)-ACP by utilizing palmitoyl (C16)-ACP (Carlsson et al., 2002, Plant Journal 29: 761-770). Therefore, by inhibiting or attenuating the expression of KasIII or KasII, inhibition of fatty acid biosynthesis during seed development may be achieved.

In one embodiment, the invention includes the transformation of a heterologous host organism or cell with a nucleic acid molecule comprising RNAi targeting either of KasII or KasIII in the host cell. In one embodiment, the host cell is a plant cell. In one embodiment, the invention includes the transformation of a heterologous host organism or cell with a nucleic acid molecule comprising antisense targeting either of KasII or KasIII in the host cell. In a preferred embodiment, the host cell is a plant cell.

In one embodiment, the invention includes transformation of a heterologous host organism or cell with a nucleic acid molecule comprising the nucleic acid sequence represented by SEQ ID NO:122, which is KAS II RNAi with CHSA intron as described in Example 13. In one embodiment, the invention includes transformation of a heterologous host organism or cell with a nucleic acid molecule comprising the nucleic acid sequence represented by SEQ ID NO:124, which is KAS III RNAi with CHSA intron as described in Example 13. In one embodiment, the invention includes transformation of a heterologous host organism or cell with a nucleic acid molecule comprising the nucleic acid sequence represented by SEQ ID NO:123, which is KAS II antisense nucleic acid sequence as described in Example 13. In one embodiment, the invention includes transformation of a heterologous host organism or cell with a nucleic acid molecule comprising the nucleic acid sequence represented by SEQ ID NO:125, which is KAS III antisense nucleic acid sequence as described in Example 13.

Additional methods for enhancing the ability of PUFA synthase enzymes to compete for the malonyl-CoA pool(s) include expression of the PUFA synthase in heterologous hosts in which competing pathways have been reduced or blocked (e.g., in Canola where the ability to elongate fatty acids in the cytoplasm has been blocked). Other suitable heterologous hosts can be selected (naturally occurring organisms and/or mutants identified by selection, random mutation and screening, and/or directed mutation) by techniques such as tilling, breeding, marker assisted selection, etc., for reduced or blocked competing pathways, such as FAS pathways and the like.

Expression of other enzymes, such as acetyl-CoA carboxylase, may also increase the malonyl CoA pool available for all enzyme systems, and thus improve flux through the PUFA PKS system.

The invention includes the enactment of any of the embodiments for improving the ability of a PUFA PKS system to use malonyl CoA with the expression of exogenous PPTases (alone or in combination with inhibition of endogenous PPTases) in conjunction with expression of a PUFA synthase as described herein, which are utilized alone or in combination with any one or more strategies described herein (e.g., any one, two, three, or four of: codon optimization, organelle-targeting, expression of an acyl CoA synthetase, and/or expression of one or more acyltransferases or related enzymes), to increase PUFA production and/or accumulation in a heterologous host.

Acyl-CoA Synthetase

Another embodiment of the present invention provides acyl-CoA synthetase (ACoAS) proteins that catalyze the conversion of long chain PUFA free fatty acids (FFA) to acyl-CoA.

The present inventors have determined that an endogenous producer of PUFAs by the PUFA PKS system, *Schizochytrium*, possesses one or more ACoASs that may be capable of converting the FFA products of its PUFA PKS system into acyl-CoA. This is evident by the fact that high levels of PUFAs accumulate in those fractions in this organism. Therefore, *Schizochytrium*, as well as other organisms that endogenously contain a PUFA PKS system (e.g., other Thraustochytrids) or other eukaryotes that produce PUFAs (such as *Thalassiosira pseudonana* or *Crypthecodinium cohnii*), represent excellent sources for genes encoding enzymes that are useful in permitting or increasing the accumulation of the products of a PUFA PKS system expressed in a heterologous host.

The present inventors have identified in *Schizochytrium* nine nucleic acid sequences encoding proteins with homology to proteins with known or suspected acyl-CoA synthetase (ACoAS) activity. The present inventors believe that one or several of these sequences is associated with a gene encoding an ACoAS capable of converting the FFA products of the *Schizochytrium* PUFA synthase into acyl-CoA, and have demonstrated the ability to use several of these sequences to increase PUFA production and/or accumulation in a host organism. As such they will have great utility for increasing the accumulation of PUFAs in the heterologous host into which the *Schizochytrium* PUFA synthase or another PUFA synthase is expressed. Without being bound by theory, the present inventors believe that the ACoAS discovered by the present inventors are useful for increasing PUFA accumulation in hosts expressing a PUFA synthase with a product profile similar to that of *Schizochytrium*, as well as in hosts expressing a PUFA synthase with a product profile that is different than that of the *Schizochytrium* PUFA synthase. Indeed, the Examples presented herein demonstrate that several ACoASs from *Schizochytrium* increase the accumulation of PUFAs in yeast strains that have been genetically modified with a *Schizochytrium* PUFA PKS system and also in plants that have been similarly genetically modified. In addition, the *Schizochytrium* ACoASs are expected to be effective in recognizing the EPA produced by PUFA synthases from other organisms if that EPA is present as a FFA. Moreover, given the disclosure provided by the present invention, the genes encoding ACoASs from other organisms can be identified and obtained for use in heterologous host organisms expressing those PUFA synthases. Each of these ACoAS proteins and the nucleic acids encoding the same are encompassed by the present invention, as well as homologues and biologically active fragments thereof. These proteins and nucleic acid molecules will be discussed in detail below and in the Examples.

One embodiment of the present invention relates to an isolated acyl-CoA synthetase (ACoAS) that catalyzes the conversion of long chain PUFA free fatty acids (FFA) to acyl-CoA. In one aspect of the invention, the isolated ACoAS is derived from an organism that endogenously expresses a PUFA PKS system (PUFA synthase). Such organisms include, but are not limited to, a Thraustochytrid. In one aspect, the isolated ACoAS is derived from *Schizochytrium*, *Thraustochytrium*, or *Ulkenia*. In another aspect, the isolated ACoAS is derived from *Schizochytrium* ATCC 20888 or from *Schizochytrium* sp. strain N230D, which is a strain derived from *Schizochytrium* ATCC 20888 by mutagenesis and selection for improved oil production. In another aspect, any ACoAS that functions in conjunction with any PUFA PKS system to increase the production and/or accumulation of PUFAs in a host cell or organism can be used in the present invention. The invention is not limited to those specific examples described herein.

In another aspect, the isolated ACoAS is encoded by a nucleotide sequence selected from any one of SEQ ID NOs: 82, 84, 86, 88, 90, 92, 94, 96, or 98. In another aspect, the isolated ACoAS is encoded by a degenerate nucleic acid sequence encoding a protein that is encoded by a nucleotide sequence selected from any one of SEQ ID NOs: 82, 84, 86, 88, 90, 92, 94, 96, or 98. In yet another aspect, the isolated ACoAS comprises an amino acid sequence selected from any one of SEQ ID NOs:83, 85, 87, 89, 91, 93, 95, 97 or 99, or a homologue of any of such amino acid sequences (described below), including any biologically active fragments or domains of such sequences. In a preferred embodiment, the isolated ACoAS comprises an amino acid sequence represented herein by SEQ ID NO: 83, 85, 87, 89, 91, 93, 95, 97 or 99, or a homologue of such amino acid sequence. In a more preferred embodiment, the isolated ACoAS comprises an amino acid sequence represented herein by SEQ ID NO:83, 85, 87, 91 or 97, or a homologue of such sequence, with SEQ ID NO:83, 85, or 97 being particularly preferred. Combinations of any one or more acyl-CoA synthetases are also encompassed by the invention.

The invention includes the expression of one or more acyl-CoA synthetases as described and exemplified herein with a PUFA synthase as described herein and with an exogenous PPTase (alone or in combination with inhibition of endogenous PPTases), which are utilized alone or in combination with any one or more strategies described herein (e.g., any one, two, three, or four of: codon optimization, organelle-targeting, enhancement of PUFA synthase competition for malonyl CoA (e.g., by inhibition of FAS), and/or expression of one or more acyltransferases or related enzymes), to increase PUFA production and/or accumulation in a heterologous host.

Acyltransferases

Relating to another strategy for increasing production and/or accumulation of PUFAs in a heterologous host described above, another embodiment of the present invention provides additional acyltransferase proteins that utilize PUFA-CoA as substrates in forming PL or TAG (e.g., 3-glycerol-phosphate acyltransferases (GPAT), lysophosphatidic acid acyltransferases (LPAAT) and diacylglycerol acyltransferases (DAGAT)) or other acyltransferases that may result in enrichment of PUFAs in PL or TAG (e.g., phospholipid:diacylglycerol acyltransferases (PDAT)). The present invention includes such isolated proteins and homologues thereof, nucleic acid molecules encoding such proteins, genetically modified organisms expressing such proteins, and various methods of using such proteins, particularly to enhance PUFA production and accumulation in an organism.

In addition, the present inventors also disclose herein that enzymes that can utilize PUFA-CoA as substrates in forming PL or TAG, and therefore represent additional accessory proteins that can be used in heterologous host organisms expressing PUFA synthases to enhance the accumulation of PUFAs produced by the PUFA synthases. Candidate enzymes include, but are not limited to, 3-glycerol-phosphate acyltransferases (GPAT), lysophosphatidic acid acyltransferases (LPAAT) and diacylglycerol acyltransferases (DAGAT). Each of these acyl-CoA-utilizing proteins and the nucleic acids encoding the same are encompassed by the present invention. For example, a *Schizochytrium* nucleic acid sequence has been identified that is believed to encode an enzyme possessing DAGAT activity (see e.g., ScDAGAT). In addition, *Crypthecodinium cohnii* sequences have been identified that are believed to encode enzymes possessing LPAAT or DAGAT activity, also described below. These proteins, biologically active homologues thereof, and nucleic acid molecules, as well as other acyltransferase proteins, homologues thereof, and nucleic acid molecules, are encompassed by the present invention and specific examples will be discussed in detail below.

Another embodiment of the present invention relates to an isolated protein that utilizes PUFA-CoA as a substrate in forming PL or TAG (e.g., 3-glycerol-phosphate acyltransferases (GPAT), lysophosphatidic acid acyltransferases (LPAAT) and diacylglycerol acyltransferases (DAGAT)). Preferred proteins include any of the acyltransferases selected from GPATs, LPAATs and DAGATs. In one aspect, the isolated proteins are derived from an organism that endogenously expresses a PUFA PKS system (PKS synthase) or at least a biosynthesis pathway for the production of PUFAs. Such organisms include, but are not limited to, a Thraustochytrid or *Crypthecodinium cohnii*. In one aspect, the isolated acyltransferase is derived from *Schizochytrium, Thraustochytrium*, or *Ulkenia*. In another aspect, the isolated acyltransferase is derived from *Schizochytrium* ATCC 20888 or from *Schizochytrium* sp. strain N230D. In another aspect, the acyltransferase is derived from *Crypthecodinium cohnii*. In another aspect, any acyltransferase that functions in conjunction with any PUFA PKS system to increase the production and/or accumulation of PUFAs in a host cell or organism can be used in the present invention. The invention is not limited to those specific examples described herein.

In another aspect, the isolated acyl transferase is encoded by a nucleotide sequence selected from any one of SEQ ID NOs:100, 102, 103, 105, 106, 108, 109, 111, 112, or 114-121. In another aspect, the isolated acyltransferase is encoded by a degenerate nucleic acid sequence encoding a protein that is encoded by a nucleotide sequence selected from any one of SEQ ID NOs: 100, 102, 103, 105, 106, 108, 109, 111, 112, or 114-121. In yet another aspect, the isolated acyltransferase comprises an amino acid sequence selected from any one of SEQ ID NOs: 101, 104, 107, 110, or 113, or a homologue of any of such amino acid sequences (described below), including any biologically active fragments or domains of such sequences. In a preferred embodiment, the isolated acyltransferase comprises an amino acid sequence represented herein by SEQ ID NO:101, 104, 107, 110, or 113, or a homologue of such amino acid sequence. In a more preferred embodiment, the isolated acyltransferase comprises an amino acid sequence represented herein by SEQ ID NO:101 or 104, or a homologue of such sequence, with SEQ ID NO:101 being particularly preferred. Combinations of acyltransferases described herein are also encompassed for use in the present invention.

In yet another aspect, the isolated acyltransferase comprises an amino acid sequence selected from any one of SEQ ID NOs: or a homologue of any of such amino acid sequences (described below), including any biologically active fragments or domains of such sequences.

The invention includes the expression of one or more acyl-CoA synthetases as described and exemplified herein with a PUFA synthase as described herein and with an exogenous PPTase (alone or in combination with inhibition of endogenous PPTases), which are utilized alone or in combination with any one or more strategies described herein (e.g., any one, two, three, or four of: codon optimization, organelle-targeting, enhancement of PUFA synthase competition for malonyl CoA (e.g., by inhibition of FAS), and/or expression of an acyl CoA synthetase), to increase PUFA production and/or accumulation in a heterologous host.

Organelle-Specific Expression

Relating to another strategy described above, one embodiment of the invention relates to the targeting of expression of the PUFA synthase enzymes, the PPTase, and/or any one or more of the accessory proteins and/or targeted genetic modifications to one or more organelles of the host. For example, in one embodiment, expression of the PUFA synthase system and the PPTase is targeted to the plastid of a plant. In another embodiment, expression of the PUFA synthase system and the PPTase is targeted to the cytosol. In another embodiment, expression of the PUFA synthase system and the PPTase is targeted to both the plastid and the cytosol of a plant. In any of these embodiments, other targets can be directed to the plastid or the cytosol. In one aspect, expression of an acyl-CoA synthetase is targeted to the cytosol, and in another embodiment, such expression is targeted to the plastid. In one embodiment, one acyl-CoA synthetase is targeted to the cytosol and another acyl-CoA synthetase is targeted to the plastid. Preferably, acyl-CoA synthetases are expressed in the cytosol to convert the DHA and/or DPA free fatty acids to Acyl-CoAs, which in turn can be utilized by the acyltransferases. Acyltransferases are generally co-translationally targeted to the endoplasmic reticulum. Inhibition of FAS systems, such as by genetic modification to inhibit one or more host enzymes, can be directed to the same organelle(s) in which the PUFA synthase is expressed.

One exemplary plastid targeting sequence is derived from a *Brassica napus* acyl-ACP thioesterase, the amino acid sequence of the encoded targeting peptide being represented herein by SEQ ID NO:81. A variety of other plastid targeting sequences are known in the art and can be used in embodiments where the heterologous host is a plant or plant cell, and wherein targeting to the plastid is desired.

The invention includes the use of organelle targeting (e.g., to the plastid or chloroplast in plants) with expression of a PUFA synthase as described herein and with an exogenous PPTase (alone or in combination with inhibition of endogenous PPTases), which are utilized alone or in combination with any one or more strategies described herein (e.g., any one, two, three, or four of: codon optimization, enhancement of PUFA synthase competition for malonyl CoA (e.g., by inhibition of FAS), expression of one or more acyl-CoA synthetases, and/or expression of one or more acyltransferases or related enzymes), to increase PUFA production and/or accumulation in a heterologous host.

The targeting of gene products to the plastid or chloroplast is controlled by a signal sequence found at the amino terminal end of various proteins and which is cleaved during import yielding the mature protein (e.g. with regard to chloroplast targeting, see, e.g., Comai et al., *J. Biol. Chem.* 263: 15104-15109 (1988)). These signal sequences can be fused to heterologous gene products to effect the import of heterologous products into the chloroplast (van den Broeck et al. Nature 313: 358-363 (1985)). DNA encoding for appropriate signal sequences can be isolated from the cDNAs encoding the RUBISCO protein, the CAB protein, the EPSP synthase enzyme, the GS2 protein and many other proteins which are known to be chloroplast localized.

In various embodiments of the invention, it may be particularly advantageous to direct the localization of proteins employed in the invention to a subcellular compartment, for example, to the plastid or chloroplast. Proteins can be directed to the chloroplast by including at their amino-terminus a chloroplast transit peptide (CTP). Similarly, proteins can be directed to the plastid by including at their N-terminus a plastid transit or signaling peptide.

Naturally occurring chloroplast targeted proteins, synthesized as larger precursor proteins containing an amino-terminal chloroplast targeting peptide directing the precursor to the chloroplast import machinery, are well known in the art. Chloroplast targeting peptides are generally cleaved by specific endoproteases located within the chloroplast organelle, thus releasing the targeted mature and preferably active enzyme from the precursor into the chloroplast milieu. Examples of sequences encoding peptides which are suitable for directing the targeting of the gene or gene product to the chloroplast or plastid of the plant cell include the petunia EPSPS CTP, the *Arabidopsis* EPSPS CTP2 and intron, and others known to those skilled in the art. Such targeting sequences provide for the desired expressed protein to be transferred to the cell structure in which it most effectively functions, or by transferring the desired expressed protein to areas of the cell in which cellular processes necessary for desired phenotypic function are concentrated. Specific examples of chloroplast targeting peptides are well known in the art and include the *Arabidopsis thaliana* ribulose bisphosphate carboxylase small subunit ats 1A transit peptide, an *Arabidopsis thaliana* EPSPS transit peptide, and a *Zea maize* ribulose bisphosphate carboxylase small subunit transit peptide.

An optimized transit peptide is described, for example, by Van den Broeck et al., "Targeting of a foreign protein to chloroplasts by fusion to the transit peptide from the small subunit of ribulose 1,5-biphosphate carboxylase", Nature, 313:358-363 (1985). Prokaryotic and eukaryotic signal sequences are disclosed, for example, by Michaelis et al. (1982) Ann. Rev. Microbiol. 36, 425. Additional examples of transit peptides that may be used in the invention include the chloroplast transit peptides such as those described in Von Heijne et al., Plant Mol. Biol. Rep. 9:104-126 (1991); Mazur et al., Plant Physiol. 85: 1110 (1987); Vorst et al., Gene 65: 59 (1988). Chen & Jagendorf (J. Biol. Chem. 268: 2363-2367 (1993)) have described use of a chloroplast transit peptide for import of a heterologous transgene. This peptide used is the transit peptide from the rbcS gene from *Nicotiana plumbaginifolia* (Poulsen et al. Mol. Gen. Genet. 205: 193-200 (1986)). One CTP that has functioned herein to localize heterologous proteins to the chloroplast was derived from *Brassica napus* acyl-ACP thioesterase.

An alternative means for localizing genes to chloroplast or plastid includes chloroplast or plastid transformation. Recombinant plants can be produced in which only the chloroplast DNA has been altered to incorporate the molecules envisioned in this application. Promoters which function in chloroplasts have been known in the art (Hanley-Bowden et al., Trends in Biochemical Sciences 12:67-70, 1987). Methods and compositions for obtaining cells containing chloroplasts into which heterologous DNA has been inserted have been described, for example by Daniell et al. (U.S. Pat. No. 5,693,507; 1997) and Maliga et al. (U.S. Pat. No. 5,451,513; 1995).

Combinations of Strategies

According to the present invention, in the production of a heterologous host for the production and accumulation of one or more target PUFAs, any one or more (any combination) of the strategies described herein for improving the production and/or accumulation of PUFAs in the host can be used. Indeed, it is anticipated that various combinations of strategies will be additive or synergistic and provide improved production and/or accumulation of PUFAs as compared to in the absence of one or more such strategies. Indeed, the Examples provide multiple exemplary strategies, including a variety of combinations of strategies, for the production of PUFAs in a host organism (both those that are heterologous hosts and organisms that naturally express a PUFA PKS system).

A suitable genetically modified host cell or organism for the production of PUFAs according to the present invention has the following base attributes. The host cell or organism expresses a PUFA PKS system, which includes the core PUFA PKS enzymes as described herein and a PPTase that is effective to produce PUFAs when used with the core PUFA PKS enzymes. The PUFA PKS system and/or the PPTase may be produced endogenously by the host cell or organism, or expressed as heterologous proteins in the host (e.g., by recombinant technology). The nucleic acid molecules encoding the core PUFA PKS enzymes and/or the PPTase may be optimized for codon usage or better expression in the host cell or organism. The host cell or organism may additionally be modified to express one, two, three, or more acyl-Co synthetases, including any of those described herein or otherwise known in the art. The host cell or organism may additionally be modified to express one, two, three, or more acyltransferases, including any of those described herein or otherwise known in the art. The host cell or organism may be additional genetically modified (or otherwise selected or produced) to enhance the ability of the PUFA PKS system to compete for the substrate, malonyl CoA. In one aspect, this is achieved by selection of an organism that has this characteristic naturally or due to a natural, selected, or directed mutation or by breeding or other technique. In another aspect, this is achieved by selectively inhibiting one or more enzymes in the pathway(s) that compete with PUFA PKS for malonyl CoA, such as the FAS system. In any of the embodiments, the targeting of the PUFA PKS or accessory proteins or modifications can be organelle-specific, such as to the plastid of plants.

Some preferred combinations for use in connection with a core PUFA PKS system and PPTase include, but are not limited to: (1) expression of one, two or more acyl-CoA synthetases; (2) FAS inhibition (e.g., by inhibition of KASII or KASIII); (3) combination of expression of one, two or more acyl-CoA synthetases with FAS inhibition (e.g., by inhibition of KASII or KASIII); (4) expression of one, two or more acyl transferases; (5) combination of expression of one, two or more acyl-CoA synthetases; FAS inhibition (e.g., by inhibition of KASII or KASIII); and expression of one, two or more acyl transferases.

Some exemplary combinations of modifications illustrated herein in plants (see Example 13) include the expression of a PUFA PKS (e.g., from *Schizochytrium*) and a heterologous PPTase (e.g., HetI from *Nostoc*) with:
 (a) Expression of an acyl-CoA synthetase (exemplified are ACS-1 and ACS-2);
 (b) FAS inhibition (exemplified are inhibition by KASII RNAi, KAS II antisense, KASIII RNAi, and KASIII antisense);
 (c) Combination of expression of an acyl-CoA synthetase with FAS inhibition (exemplified are expression of ACS-1 with FAS inhibition by each of KASII RNAi, KAS II antisense, KASIII RNAi, and KASIII antisense);
 (d) Expression of an acyltransferase (exemplified is LPAAT-1);
 (e) Combination of expression of an acyltransferase with expression of an acyl-CoA synthetase and with FAS inhibition (exemplified is expression of DAGAT-1 with expression of ACS-1, each combination with inhibition of FAS by KASII RNAi or KASIII antisense);
 (f) Combination of expression of an acyltransferase with expression of two acyl-CoA synthetases and with FAS inhibition (exemplified is expression of DAGAT-1 with expression of ACS-1, expression of ACS-8, each combination with inhibition of FAS by KASII RNAi or KASIII antisense);
 (g) Combination of expression of two acyltransferases with expression of an acyl-CoA synthetase and with FAS inhibition (exemplified is expression of DAGAT-1 and LPAAT-1 with expression of ACS-1, each combination with inhibition of FAS by KASII RNAi or KASIII antisense); and
 (h) Combination of expression of two acyltransferases with expression of two acyl-CoA synthetases and with FAS inhibition (exemplified is expression of DAGAT-1 and LPAAT-1 with expression of ACS-1 and ACS-8, each combination with inhibition of FAS by KASII RNAi or KASIII antisense).

Any plant or plant cell using these combinations of modifications, or any other modification or combination of modifications described herein, is encompassed by the invention. Furthermore, any host cell or organism using any modifications or combination of modifications described herein is encompassed by the invention, as are any products derived from such cell or organisms, including oils comprising the target PUFAs. All of these embodiments of the invention apply to the discussion of any of the genetically modified organisms and methods of producing and using such organisms as described herein.

Genetically Modified Cells, Organisms, and Methods of Producing and Using the Same To produce significantly high yields of one or more desired polyunsaturated fatty acids or other bioactive molecules, an organism, preferably a microorganism or a plant, can be genetically modified to alter the activity and particularly, the end product, of the PUFA PKS system in the microorganism or plant or to introduce a PUFA PKS system into the microorganism or plant. The present invention relates to methods to improve or enhance the effectiveness of such genetic modification and particularly, to improve or enhance the production and/or accumulation of the end product of a PUFA PKS system, preferably PUFA(s).

Therefore, one embodiment of the present invention relates to a genetically modified organism, wherein the organism expresses a PUFA PKS system, and wherein the organism has been genetically modified to express an accessory protein as described herein for the improvement of the production and/or accumulation of PUFAs (or other bioactive products of the PUFA PKS system) by the host, and/or wherein the organism has been genetically modified by any method, including natural selection and mutation, to enhance the ability of the PUFA PKS to compete for substrate within the host (e.g., by inhibition of FAS pathways and other competing pathways described herein). If the PUFA PKS system is heterologous to the host, then the organism is also preferably genetically modified to express a PPTase as a PUFA PKS accessory protein, which is described in detail above. In one embodiment, the organism has been genetically modified to express an ACoAS described herein, and preferably an ACoAS that is derived from the same genus, species or specific organism as the organism from which the PUFA PKS system is derived, or is capable of catalyzing the conversion of long chain PUFA free fatty acids (FFA) produced by the PUFA PKS system to acyl-CoA. In another embodiment, the organism has been genetically modified to express a protein that utilizes PUFA-CoA as substrates in forming PL or TAG. In yet another embodiment, the organism has been genetically modified to express both the above-described ACoAS and a protein that utilizes PUFA-CoA as substrates in forming PL or TAG. In one embodiment, if the PUFA PKS system is endogenous to the host, the organism can be genetically modified to express a heterologous accessory protein as described above that improves or enhances the production and/or accumulation of PUFAs (or another bioactive product of the PUFA PKS system) in the host organism, and/or the organism can be genetically modified to increase, optimize, or enhance the expression and/or biological activity of such an accessory protein that is endogenously expressed by the organism (e.g., to improve the expression or activity of an endogenous ACoAS that operates with the endogenous PUFA PKS system in the host). In one embodiment, the organism is genetically modified by any method, including natural selection and mutation, directed mutation, or random mutation and screening, etc., to enhance the ability of the PUFA PKS to compete for substrate within the host (e.g., by inhibition of FAS pathways and other competing pathways described herein). In one embodiment, the FAS pathway in the organism is inhibited. In one embodiment, KASII and/or KASIII in the organism is inhibited. These embodiments of the invention are described in detail above. Preferred genetically modified organisms include genetically modified microorganisms and genetically modified plants.

The organism can endogenously express a PUFA PKS system, although the present invention is especially useful for enhancing the production and/or accumulation of PUFAs in organisms that are genetically modified to express the PUFA PKS system (heterologous hosts). The PUFA PKS system expressed by the organism can include any PUFA PKS system, for example, PUFA PKS systems that are entirely derived from a particular organism (e.g., a *Schizochytrium* PUFA PKS system), as well as PUFA PKS systems that are produced by "mixing and matching" nucleic acid sequences encoding proteins and/or domains from different PUFA PKS systems (e.g., by mixing *Schizochytrium* PUFA PKS proteins and/or domains with PUFA PKS proteins and/or domains from, e.g., *Thraustochytrium, Ulkenia, Shewanella, Moritella,* and/or *Photobacterium*, etc.) and/or from different non-PUFA PKS systems (e.g., type I modular, type I iterative, type II or type III PKS systems), where the proteins and/or domains from different organisms are combined to form a complete, functional PUFA PKS system. PUFA PKS systems, including combining PUFA PKS genes or proteins from different organisms, are described in detail in U.S. Pat. No. 6,140,486; U.S. Pat. No. 6,566,583; Metz et al., *Science* 293: 290-293 (2001); U.S. Patent Application Publication No. 20020194641; U.S. Patent Application Publication No. 20040235127; U.S. Patent Application Publication No. 20050100995; and PCT Publication No. WO 2006/135866; supra). PUFA PKS genes and proteins are also disclosed in: PCT Patent Publication No. WO 05/097982; and U.S. Patent Application Publication No. 20050014231. Each of the above-identified disclosures, and the genes and proteins described therein, is incorporated herein by reference.

Accordingly, encompassed by the present invention are methods to genetically modify organisms by: genetically modifying at least one nucleic acid sequence in the organism that encodes at least one functional domain or protein (or biologically active fragment or homologue thereof) of a PUFA PKS system, including, but not limited to, any PUFA PKS system specifically described herein, and/or by expressing at least one recombinant nucleic acid molecule comprising a nucleic acid sequence encoding such domain or protein. In addition, the methods include genetically modifying the organisms by genetically modifying at least one nucleic acid sequence in the organism that encodes an ACoAS and/or a protein that utilizes PUFA-CoA as substrates in forming PL or TAG at least one functional domain or protein, and/or by expressing at least one recombinant nucleic acid molecule comprising a nucleic acid sequence encoding such protein(s). The methods can further include genetically modifying the organism to inhibit a pathway that competes with the PUFA PKS for substrate, such as the FAS system, including, but not limited to, inhibition of KASII or KASIII in the organism. In one embodiment, any of the exogenously introduced nucleic acid sequences can be optimized for codon usage or improved expression in the host. In one embodiment, any of the introduced nucleic acid sequences can be targeted to one or more organelles in the organism. Various embodiments of such sequences, methods to genetically modify an organism, specific modifications, and combinations thereof have been described in detail above and are encompassed here. Typically, the method is used to produce a particular genetically modified organism that produces a particular bioactive molecule or molecules. Preferably the genetically modified organism is a genetically modified microorganism or a genetically modified plant.

Preferably, a genetically modified organism of the invention produces one or more polyunsaturated fatty acids including, but not limited to, EPA (C20:5, n-3), DHA (C22:6, n-3), DPA (C22:5, n-6 or n-3), ARA (C20:4, n-6), GLA (C18:3, n-6), ALA (C18:3, n-3), and/or SDA (C18:4, n-3)), and more preferably, one or more longer chain PUFAs, including, but not limited to, EPA (C20:5, n-3), DHA (C22:6, n-3), DPA (C22:5, n-6 or n-3), or DTA (C22:4, n-6), or any combination thereof. In a particularly preferred embodiment, a genetically modified plant of the invention produces one or more polyunsaturated fatty acids including, but not limited to, EPA (C20:5, n-3), DHA (C22:6, n-3), and/or DPA (C22:5, n-6 or n-3), or any combination thereof.

According to the present invention, a genetically modified organism includes an organism that has been modified using recombinant technology or by classical mutagenesis and screening techniques. As used herein, genetic modifications that result in a decrease in gene expression, in the function of the gene, or in the function of the gene product (i.e., the protein encoded by the gene) can be referred to as inactivation (complete or partial), deletion, interruption, blockage or down-regulation of a gene. For example, a genetic modification in a gene which results in a decrease in the function of the protein encoded by such gene, can be the result of a complete deletion of the gene (i.e., the gene does not exist, and therefore the protein does not exist), a mutation in the gene which results in incomplete or no translation of the protein (e.g., the protein is not expressed), or a mutation in the gene which decreases or abolishes the natural function of the protein (e.g., a protein is expressed which has decreased or no enzymatic activity or action). Genetic modifications that result in an increase in gene expression or function can be referred to as amplification, overproduction, overexpression, activation, enhancement, addition, or up-regulation of a gene.

The genetic modification of an organism according to the present invention preferably affects the activity of the PUFA PKS system expressed by the organism, whether the PUFA PKS system is endogenous and genetically modified, endogenous with the introduction of recombinant nucleic acid molecules into the organism (with the option of modifying the endogenous system or not), or provided completely by recombinant technology. To alter the PUFA production profile of a PUFA PKS system or organism expressing such system includes causing any detectable or measurable change in the production of any one or more PUFAs (or other bioactive molecule produced by the PUFA PKS system) by the host organism as compared to in the absence of the genetic modification (i.e., as compared to the unmodified, wild-type organism or the organism that is unmodified at least with respect to PUFA synthesis—i.e., the organism might have other modifications not related to PUFA synthesis). To affect the activity of a PUFA PKS system includes any genetic modification that causes any detectable or measurable change or modification in the PUFA PKS system expressed by the organism as compared to in the absence of the genetic modification. A detectable change or modification in the PUFA PKS system can include, but is not limited to: a change or modification (introduction of, increase or decrease) of the expression and/or biological activity of any one or more of the domains in a modified PUFA PKS system as compared to the endogenous PUFA PKS system in the absence of genetic modification; the introduction of PUFA PKS system activity (i.e., the organism did not contain a PKS system or a PUFA PKS system prior to the genetic modification) into an organism such that the organism now has measurable/detectable PUFA PKS system activity.

It should be noted that reference to increasing the activity of a functional domain or protein in a PUFA PKS system, including in an accessory protein to a PUFA PKS system, refers to any genetic modification in the organism containing the domain or protein (or into which the domain or protein is to be introduced) which results in increased functionality of the domain or protein or system and can include higher activity of the domain or protein or system (e.g., specific activity or in vivo enzymatic activity), reduced inhibition or degradation of the domain or protein or system, and overexpression of the domain or protein or system. For example, gene copy number can be increased, expression levels can be increased by use of a promoter that gives higher levels of expression than that of the native promoter, or a gene can be altered by genetic engineering or classical mutagenesis to increase the activity of the domain or protein encoded by the gene.

Similarly, reference to decreasing the activity of a functional domain or protein in a PUFA PKS system, including in an accessory protein to a PUFA PKS system, refers to any genetic modification in the organism containing such domain or protein (or into which the domain or protein is to be introduced) which results in decreased functionality of the domain or protein and includes decreased activity of the domain or protein, increased inhibition or degradation of the domain or protein and a reduction or elimination of expression of the domain or protein. For example, the action of domain or protein of the present invention can be decreased by blocking or reducing the production of the domain or protein, "knocking out" the gene or portion thereof encoding the domain or protein, reducing domain or protein activity, or inhibiting the activity of the domain or protein. Blocking or reducing the production of a domain or protein can include placing the gene encoding the domain or protein under the control of a promoter that requires the presence of an inducing compound in the growth medium. By establishing conditions such that the inducer becomes depleted from the medium, the expression of the gene encoding the domain or protein (and therefore, of protein synthesis) could be turned off. The present inventors demonstrate the ability to delete (knock out) targeted genes in a Thraustochytrid microorganism in the Examples section. Blocking or reducing the activity of domain or protein could also include using an excision technology approach similar to that described in U.S. Pat. No. 4,743,546, incorporated herein by reference. To use this approach, the gene encoding the protein of interest is cloned between specific genetic sequences that allow specific, controlled excision of the gene from the genome. Excision could be prompted by, for example, a shift in the cultivation temperature of the culture, as in U.S. Pat. No. 4,743,546, or by some other physical or nutritional signal.

Genetically Modified Microorganisms

As used herein, a genetically modified microorganism can include a genetically modified bacterium, protist, microalgae, algae, fungus, or other microbe. Such a genetically modified microorganism has a genome which is modified (i.e., mutated or changed) from its normal (i.e., wild-type or naturally occurring) form such that the desired result is achieved (i.e., increased or modified PUFA PKS activity and/or production and accumulation of a desired product using the PUFA PKS system). Genetic modification of a microorganism can be accomplished using classical strain development and/or molecular genetic techniques. Such techniques known in the art and are generally disclosed for microorganisms, for example, in Sambrook et al., 1989, *Molecular Cloning: A Laboratory Manual*, Cold Spring Harbor Labs Press. The reference Sambrook et al., ibid., is incorporated by reference herein in its entirety. A genetically modified microorganism can include a microorganism in which nucleic acid molecules have been inserted, deleted or modified (i.e., mutated; e.g., by insertion, deletion, substitution, and/or inversion of nucleotides), in such a manner that such modifications provide the desired effect within the microorganism.

Examples of suitable host microorganisms for genetic modification include, but are not limited to, yeast including *Saccharomyces cerevisiae*, *Saccharomyces carlsbergensis*, or other yeast such as *Candida*, *Kluyveromyces*, or other fungi, for example, filamentous fungi such as *Aspergillus*, *Neurospora*, *Penicillium*, etc. Bacterial cells also may be used as hosts. These include, but are not limited to, *Escherichia coli*, which can be useful in fermentation processes. Alternatively, and only by way of example, a host such as a *Lactobacillus* species or *Bacillus* species can be used as a host.

Other hosts for use in the present invention include microorganisms from a genus including, but not limited to: *Thraustochytrium*, *Japonochytrium*, *Aplanochytrium*, *Elina* and *Schizochytrium* within the Thraustochytriaceae, and *Labyrinthula*, *Labyrinthuloides*, and *Labyrinthomyxa* within the Labyrinthulaceae. Preferred species within these genera include, but are not limited to: any species described below. Particularly preferred strains of Thraustochytriales include, but are not limited to: *Schizochytrium* sp. (S31)(ATCC 20888); *Schizochytrium* sp. (S8)(ATCC 20889); *Schizochytrium* sp. (LC-RM)(ATCC 18915); *Schizochytrium* sp. (SR21); *Schizochytrium* sp. N230D, *Schizochytrium aggregatum* (Goldstein et Belsky)(ATCC 28209); *Schizochytrium limacinum* (Honda et Yokochi)(IFO 32693); *Thraustochytrium* sp. (23B)(ATCC 20891); *Thraustochytrium striatum* (Schneider)(ATCC 24473); *Thraustochytrium aureum* (Goldstein)(ATCC 34304); *Thraustochytrium roseum* (Goldstein)(ATCC 28210); and *Japonochytrium* sp. (L1)(ATCC 28207).

According to the present invention, the term "thraustochytrid" refers to any members of the order Thraustochytriales, which includes the family Thraustochytriaceae, and the term "labyrinthulid" refers to any member of the order Labyrinthulales, which includes the family Labyrinthulaceae. The members of the family Labyrinthulaceae were at one time considered to be members of the order Thraustochytriales, but in more recent revisions of the taxonomy of such organisms, the family is now considered to be a member of the order Labyrinthulales, and both Labyrinthulales and Thraustochytriales are considered to be members of the phylum Labyrinthulomycota. Developments have resulted in frequent revision of the taxonomy of the thraustochytrids and labyrinthulids. However, taxonomic theorists now generally place both of these groups of microorganisms with the algae or algae-like protists within the Stramenopile lineage. The current taxonomic placement of the thraustochytrids and labyrinthulids can be summarized as follows:

Realm: Stramenopila (Chromista)
Phylum: Labyrinthulomycota
Class: Labyrinthulomycetes
Order: Labyrinthulales
Family: Labyrinthulaceae
Order: Thraustochytriales
Family: Thraustochytriaceae However, because of remaining taxonomic uncertainties it would be best for the purposes of the present invention to consider the strains described in the present invention as thraustochytrids to include the following organisms: Order: Thraustochytriales; Family: Thraustochytriaceae; Genera: *Thraustochytrium* (Species: sp., *arudimentale, aureum, benthicola, globosum, kinnei, motivum, multirudimentale, pachydermum, proliferum, roseum, striatum*), *Ulkenia* (Species: sp., *amoeboidea, kerguelensis, minuta, profunda, radiata, sailens, sarkariana, schizochytrops, visurgensis, yorkensis*), *Schizochytrium* (Species: sp., *aggregatum, limnaceum, mangrovei, minutum, octosporum*), *Japonochytrium* (Species: sp., *marinum*), *Aplanochytrium* (Species: sp., *haliotidis, kerguelensis, profunda, stocchinoi*), *Althornia* (Species: sp., *crouchii*), or *Elina* (Species: sp., *marisalba, sinorifica*). It is to be noted that the original description of the genus *Ulkenia* was not published in a peer-reviewed journal so some questions remain as to the validity of this genus and the species placed within it. For the purposes of this invention, species described within *Ulkenia* will be considered to be members of the genus *Thraustochytrium*.

Strains described in the present invention as Labyrinthulids include the following organisms: Order: Labyrinthulales, Family: Labyrinthulaceae, Genera: *Labyrinthula* (Species: sp., *algeriensis, coenocystis, chattonii, macrocystis, macrocystis atlantica, macrocystis macrocystis, marina, minuta, roscoffensis, valkanovii, vitellina, vitellina pacifica, vitellina vitellina, zopfii*), *Labyrinthuloides* (Species: sp., *haliotidis, yorkensis*), *Labyrinthomyxa* (Species: sp., *marina*), *Diplophrys* (Species: sp., *archeri*), *Pyrrhosorus* (Species: sp., *marinus*), *Sorodiplophrys* (Species: sp., *stercorea*) or *Chlamydomyxa* (Species: sp., *labyrinthuloides, montana*) (although there is currently not a consensus on the exact taxonomic placement of *Pyrrhosorus, Sorodiplophrys* or *Chlamydomyxa*).

In one embodiment of the present invention, the endogenous PUFA PKS system and/or the endogenous PUFA PKS accessory proteins (e.g., ACoAS) of a microorganism is genetically modified by, for example, classical mutagenesis and selection techniques and/or molecular genetic techniques, include genetic engineering techniques. Genetic engineering techniques can include, for example, using a targeting recombinant vector to delete a portion of an endogenous gene or to replace a portion of an endogenous gene with a heterologous sequence. Examples of heterologous sequences that could be introduced into a host genome include sequences encoding at least one functional PUFA PKS domain or protein from another PKS system or even an entire PUFA PKS system (e.g., all genes associated with the PUFA PKS system). A heterologous sequence can also include a sequence encoding a modified functional domain (a homologue) of a natural domain from a PUFA PKS system. Other heterologous sequences that can be introduced into the host genome include nucleic acid molecules encoding proteins that affect the activity of the endogenous PUFA PKS system, such as the accessory proteins described herein. For example, one could introduce into the host genome a nucleic acid molecule encoding a ACoAS, and particularly, an ACoAS that enhances the production and/or accumulation of PUFAs in the host as compared to the endogenous ACoAS that operates with the PUFA PKS system.

Genetically Modified Plants

Another embodiment of the present invention relates to a genetically modified plant, wherein the plant has been genetically modified to recombinantly express a PUFA PKS system, including a PPTase, as described herein, and wherein the plant has been further genetically modified to express an accessory protein as described herein for the improvement of the production and/or accumulation of PUFAs (or other bioactive products of the PUFA PKS system) by the host and/or to inhibit pathways that compete with the PUFA PKS system (e.g., inhibition of the FAS system). Preferably, such accessory protein is an ACoAS and/or a protein that utilizes PUFA-CoA as substrates in forming PL or TAG (e.g., a GPAT, LFAAT, or DAGAT).

As used herein, a genetically modified plant can include any genetically modified plant including higher plants and particularly, any consumable plants or plants useful for producing a desired bioactive molecule (e.g., PUFA) of the present invention. "Plant parts", as used herein, include any parts of a plant, including, but not limited to, seeds (including mature seeds and immature seeds), pollen, embryos, flowers, fruits, shoots, leaves, roots, stems, explants, etc. A genetically modified plant has a genome which is modified (i.e., mutated or changed) from its normal (i.e., wild-type or naturally occurring) form such that the desired result is achieved (i.e., increased or modified PUFA PKS activity and/or production and/or accumulation of a desired product using the PUFA PKS system). Genetic modification of a plant can be accomplished using classical strain development and/or molecular genetic techniques. Methods for producing a transgenic plant, wherein a recombinant nucleic acid molecule encoding a desired amino acid sequence is incorporated into the genome of the plant, are known in the art. A preferred plant to genetically modify according to the present invention is preferably a plant suitable for consumption by animals, including humans.

Preferred plants to genetically modify according to the present invention (i.e., plant host cells) include, but are not limited to any higher plants, including both dicotyledonous and monocotyledonous plants, and particularly consumable plants, including crop plants and especially plants used for their oils. Such plants can include, but are not limited to, for example: canola, soybeans, rapeseed, linseed, corn, safflowers, sunflowers and tobacco. Thus, any plant species or plant cell may be selected. Particular cells used herein, and plants grown or derived therefrom, include, but are not limited to, cells obtainable from canola (*Brassica rapa* L.); soybean (*Glycine max*); rapeseed (*Brassica* spp.); linseed/flax (*Linum usitatissimum*); maize (corn) (*Zea mays*); safflower (*Carthamus tinctorius*); sunflower (*Helianthus annuus*); tobacco (*Nicotiana tabacum*); *Arabidopsis thaliana*, Brazil nut (*Betholettia excelsa*); castor bean (*Riccinus communis*); coconut (*Cocus nucifera*); coriander (*Coriandrum sativum*); cotton (*Gossypium* spp.); groundnut (*Arachis hypogaea*); jojoba (*Simmondsia chinensis*); mustard (*Brassica* spp. and *Sinapis*

*alba*); oil palm (*Elaeis guineeis*); olive (*Olea eurpaea*); rice (*Oryza sativa*); squash (*Cucurbita maxima*); barley (*Hordeum vulgare*); wheat (*Traeticum aestivum*); and duckweed (*Lemnaceae* sp.). It should be noted that in accordance herewith the genetic background within a plant species may vary.

Plant lines from these plants, optimized for a particularly desirable trait, e.g. disease resistance, ease of plant transformation, oil content or profile, etc., may be produced, selected or identified in accordance herewith. Preferred plant lines may be selected through plant breeding, or through methods such as marker assisted breeding and tilling. It should be noted that plant lines displaying modulated activity with respect to any of the herein mentioned accessory proteins, targeted inhibition of pathways, and/or the PUFA PKS system (PUFA synthase) are particularly useful.

In a further embodiment plant cell cultures may be used in accordance herewith. In such embodiments plant cells are not grown into differentiated plants and cultivated using ordinary agricultural practices, but instead grown and maintained in a liquid medium.

Other preferred plants include those plants that are known to produce compounds used as pharmaceutical agents, flavoring agents, nutraceutical agents, functional food ingredients or cosmetically active agents or plants that are genetically engineered to produce these compounds/agents.

As discussed above, the PUFA PKS synthase of the present invention does not utilize the fatty acid products of FAS systems. Instead, it produces the final PUFA product (the primary PUFA product) from the same small precursor molecule that is utilized by FASs and elongases (malonyl-CoA). Therefore, intermediates in the synthesis cycle are not released in any significant amount, and the PUFA product (also referred to herein as the primary PUFA product) is efficiently transferred to phospholipids (PL) and triacylglycerol (TAG) fractions of the lipids. Indeed, a PUFA PKS system may produce two target or primary PUFA products (e.g., the PUFA PKS system from *Schizochytrium* produces both DHA and DPA n-6 as primary products), but DPA is not an intermediate in the pathway to produce DHA. Rather, each is a separate product of the same PUFA PKS system. Therefore, PUFA PKS genes are an excellent means of producing oils containing PUFAs, and particularly, long chain PUFAs (LCPUFAs) in a heterologous host, such as a plant, wherein the oils are substantially free (defined below) of the intermediates and side products that contaminate oils produced by the "standard" PUFA pathway (also defined below).

Therefore, it is an object of the present invention to produce, via the genetic manipulation of plants as described herein, polyunsaturated fatty acids of desired chain length and with desired numbers of double bonds and, by extension, oil seed and oils obtained from such plants (i.e., obtained from the oil seeds of such plants) comprising these PUFAs. Examples of PUFAs that can be produced by the present invention include, but are not limited to, DHA (docosahexaenoic acid (C22:6, n-3)), ARA (eicosatetraenoic acid or arachidonic acid (C20:4, n-6)), DPA (docosapentaenoic acid (C22:5, n-6 or n-3)), and EPA (eicosapentaenoic acid (C20:5, n-3)) and any combinations thereof. The present invention allows for the production of commercially valuable lipids enriched in one or more desired (target or primary) PUFAs by the present inventors' development of genetically modified plants through the use of the polyketide synthase-like system that produces PUFAs.

According to the present invention, reference to a "primary PUFA", "target PUFA", "intended PUFA", or "desired PUFA" refers to the particular PUFA or PUFAs that are the intended or targeted product of the enzyme pathway that is used to produce the PUFA(s). For example, when using elongases and desaturases to modify products of the FAS system, one can select particular combinations of elongases and desaturases that, when used together, will produce a target or desired PUFA (e.g., DHA or EPA). As discussed above, such target or desired PUFA produced by the standard pathway may not actually be a "primary" PUFA in terms of the amount of PUFA as a percentage of total fatty acids produced by the system, due to the formation of intermediates and side products that can actually represent the majority of products produced by the system. However, one may use the term "primary PUFA" even in that instance to refer to the target or intended PUFA product produced by the elongases or desaturases used in the system.

When using a PUFA PKS system as preferred in the present invention, a given PUFA PKS system derived from a particular organism will produce particular PUFA(s), such that selection of a PUFA PKS system from a particular organism will result in the production of specified target or primary PUFAs. For example, use of a PUFA PKS system from *Schizochytrium* will result in the production of DHA and DPAn-6 as the target or primary PUFAs. Use of a PUFA PKS system from various *Shewanella* species, on the other hand, will result in the production of EPA as the target or primary PUFA. It is noted that the ratio of the primary or target PUFAs can differ depending on the selection of the particular PUFA PKS system and on how that system responds to the specific conditions in which it is expressed. For example, use of a PUFA PKS system from *Thraustochytrium* 23B (ATCC No. 20892) will also result in the production of DHA and DPAn-6 as the target or primary PUFAs; however, in the case of *Thraustochytrium* 23B, the ratio of DHA to DPAn-6 is about 10:1 (and can range from about 8:1 to about 40:1), whereas in *Schizochytrium*, the ratio is typically about 2.5:1. Therefore, use of a *Thraustochytrium* PUFA PKS system or proteins or domains can alter the ratio of PUFAs produced by an organism as compared to *Schizochytrium* even though the target PUFAs are the same. In addition, as discussed below, one can also modify a given PUFA PKS system by intermixing proteins and domains from different PUFA PKS systems or PUFA PKS and PKS systems, or one can modify a domain or protein of a given PUFA PKS system to change the target PUFA product and/or ratios.

According to the present invention, reference to "intermediate products" or "side products" of an enzyme system that produces PUFAs refers to any products, and particularly, fatty acid products, that are produced by the enzyme system as a result of the production of the target or primary PUFA(s) of the system, but which are not the primary or target PUFA(s). In one embodiment, intermediate and side products may include non-target fatty acids that are naturally produced by the wild-type plant, or by the parent plant used as a recipient for the indicated genetic modification, but are now classified as intermediate or side products because they are produced in greater levels as a result of the genetic modification, as compared to the levels produced by the wild-type plant, or by the parent plant used as a recipient for the indicated genetic modification. Intermediate and side products are particularly significant in the standard pathway for PUFA synthesis and are substantially less significant in the PUFA PKS pathway, as discussed above. It is noted that a primary or target PUFA of one enzyme system may be an intermediate of a different enzyme system where the primary or target product is a different PUFA, and this is particularly true of products of the standard pathway of PUFA production, since the PUFA PKS system substantially avoids the production of intermediates. For example, when using the standard pathway to produce EPA, fatty acids such as GLA, DGLA and SDA are produced as intermediate products in significant quantities (e.g., U.S. Patent Application Publication 2004/0172682 illustrates this point). Similarly, and also illustrated by U.S. Patent Application Publication 2004/0172682, when using the standard pathway to produce DHA, in addition to the fatty acids mentioned above, ETA and EPA (notably the target PUFA in the first example above) are produced in significant quantities and in fact, may be present in significantly greater quantities relative to the total fatty acid product than the target PUFA itself. This latter point is also shown in U.S. Patent Application Publication 2004/0172682, where a plant that was engineered to produce DHA by the standard pathway produces more EPA as a percentage of total fatty acids than the targeted DHA.

To produce significantly high yields of one or more desired polyunsaturated fatty acids, a plant can be genetically modified to introduce a PUFA PKS system into the plant. Plants are not known to endogenously contain a PUFA PKS system, and therefore, the PUFA PKS systems of the present invention represent an opportunity to produce plants with unique fatty acid production capabilities. It is a particularly preferred embodiment of the present invention to genetically engineer plants to produce one or more PUFAs in the same plant, including, EPA, DHA, DPA (n3 or n6), ARA, GLA, SDA and others, including any combination thereof. The present invention offers the ability to create any one of a number of "designer oils" in various ratios and forms. Moreover, the disclosure of the PUFA PKS genes from the particular marine organisms described herein offer the opportunity to more readily extend the range of PUFA production and successfully produce such PUFAs within temperature ranges used to grow most crop plants.

Therefore, one embodiment of the present invention relates to a genetically modified plant or part of a plant (e.g., wherein the plant has been genetically modified to express a PUFA PKS system described herein), which includes the core PUFA PKS enzyme complex and a PPTase, as described herein, wherein the plant has been further genetically modified to express an accessory protein as described herein for the improvement of the production and/or accumulation of PUFAs (or other bioactive products of the PUFA PKS system) by the host and/or wherein the plant has been genetically modified to inhibit pathways that compete with the PUFA PKS system (e.g., inhibition of the FAS system) as described herein. Preferably, such accessory protein is an ACoAS and/or a protein that utilizes PUFA-CoA as substrates in forming PL or TAG (e.g., a GPAT, LFAAT, or DAGAT) so that the plant produces PUFAs.

Preferably, such additional genetic modification is any modification (naturally occurring, selected, or synthesized) that increases the flux through the PUFA synthase pathway by reducing competition for the malonyl-CoA pool(s). There are many possible ways to achieve enhanced ability to compete for this substrate. These include, but are not limited to, 1) inhibition of competing pathways, including inhibition of any elements in the FAS pathway, e.g., by reducing expression levels of enzymes or subunits involved in those pathways (e.g., by use of antisense RNA, RNAi, co-suppression, or mutations), 2) expression of the PUFA synthase in heterologous hosts in which competing pathways have been reduced or blocked (e.g., in Canola where the ability to elongate fatty acids in the cytoplasm has been blocked), and/or 3) by increasing the pool of malonyl-CoA (e.g., by expression of acetyl-CoA carboxylase). In one embodiment, KASII and/or KASIII are inhibited in the plant (e.g., by RNAi or by antisense).

As discussed above, the genetically modified plant useful in the present invention has been genetically modified to express a PUFA PKS system. The PUFA PKS system can include any PUFA PKS system, such as any PUFA PKS system described in, for example, U.S. Pat. No. 6,566,583; U.S. Patent Application Publication No. 20020194641; U.S. Patent Application Publication No. 20040235127; U.S. Patent Application Publication No. 20050100995; and PCT Publication No. WO 2006/135866. The PUFA PKS system can be chosen from, but is not limited to, any of the specific PUFA PKS systems identified and characterized in these patents and patent publications, such as the PUFA PKS systems from *Schizochytrium* sp. American Type Culture Collection (ATCC) No. 20888, and mutant strains derived therefrom (e.g., strain N230D); *Thraustochytrium* 23B ATCC No. 20892, and mutant strains derived therefrom; *Shewanella olleyana* Australian Collection of Antarctic Microorganisms (ACAM) strain number 644, and mutant strains derived therefrom; or *Shewanella japonica* ATCC strain number BAA-316, and mutant strains derived therefrom.

In one embodiment, the PUFA PKS system comprises domains selected from any of the above PUFA PKS systems, wherein the domains are combined (mixed and matched) to form a complete PUFA PKS system meeting the minimum requirements as discussed above. The plant can also be further modified with at least one domain or biologically active fragment thereof of another PKS system, including, but not limited to, Type I PKS systems (iterative or modular), Type II PKS systems, and/or Type III PKS systems, which may substitute for a domain in a PUFA PKS system. Finally, any of the domains of a PUFA PKS system can be modified from their natural structure to modify or enhance the function of that domain in the PUFA PKS system (e.g., to modify the PUFA types or ratios thereof produced by the system). Such mixing of domains to produce chimeric PUFA PKS proteins is described in the patents and patent publications referenced above.

Preferably, a plant having any of the above-identified characteristics is a plant that has been genetically modified to express a PUFA PKS system (PUFA synthase) as described in detail herein (i.e., the PUFA PKS system is the enzyme system that produces the target PUFA(s) in the plant). In one embodiment, the plant has been genetically modified to express a PUFA PKS system comprised of PUFA PKS proteins/domains from a thraustochytrid, including, but not limited to, *Schizochytrium*, *Thraustochytrium*, *Ulkenia*, *Japonochytrium*, *Aplanochytrium*, *Althornia*, or *Elina*. In one embodiment, the plant has been genetically modified to express a PUFA PKS system comprised of PUFA PKS proteins/domains from a labrynthulid. In another embodiment, the plant has been genetically modified to express a PUFA PKS system comprised of PUFA PKS proteins/domains from a marine bacterium, including, but not limited to, *Shewanella japonica* or *Shewanella olleyana*. In one embodiment, the plant has been genetically modified to express a PUFA PKS system comprised of *Schizochytrium* OrfsA, B and C (including homologues or synthetic versions thereof), and a PPTase (e.g., HetI) as described above (e.g., see SEQ ID NOs:1-32 and SEQ ID NO:33, and discussion of *Schizochytrium* PUFA PKS system above). In another embodiment, the plant has been genetically modified to express a PUFA PKS system comprised of *Thraustochytrium* OrfsA, B and C (including homologues or synthetic versions thereof), and a PPTase (e.g., HetI) as described above (e.g., see SEQ ID NOs:38-68 and SEQ ID NO:33, and discussion of *Thraustochytrium* PUFA PKS system above; see also U.S. Patent Application Publication No. 20050014231). In another embodiment, the plant has been genetically modified to express a PUFA PKS system comprised of other thraustochytrid OrfsA, B and C (including homologues or synthetic versions thereof), and a PPTase (e.g., HetI) (e.g., see PCT Patent Publication No. WO 05/097982). In another embodiment, the plant has been genetically modified to express a PUFA PKS system comprised of PUFA PKS Orfs from marine bacteria such as *Shewanella* (including homologues or synthetic versions thereof), and a PPTase (e.g., the endogenous *Shewanella* PPTase) as described above (e.g., see SEQ ID NOs:1-6 for *Shewanella japonica*, SEQ ID NOs: 7-12 for *Shewanella olleyana*). In another embodiment, the plant has been genetically modified to express any combinations of domains and proteins from such PUFA PKS systems (e.g., a chimeric PUFA PKS system).

Finally, as discussed above, the genetic modification of the plant may include the introduction of one or more accessory proteins that will work with the core PUFA PKS enzyme complex to enable, facilitate, or enhance production of PUFAs by the plant, and/or a genetic modification that results in enhanced flux of malonyl CoA substrate through the PUFA PKS system, such as by any inhibition of the FAS system described herein, or the use of other strategies for achieving the same result as described herein. The genetic modification of the plant can also include the optimization of genes for preferred host codon usage, as well as targeting of the PUFA synthase enzymes to particular organelles (e.g., the plastid).

Preferably, the plant is an oil seed plant, wherein the oil seeds, and/or the oil in the oil seeds, contain PUFAs produced by the PUFA PKS system. Such oils contain a detectable amount of at least one target or primary PUFA that is the product of the PUFA PKS system. Additionally, such oils are substantially free of intermediate or side products that are not the target or primary PUFA products and that are not naturally produced by the endogenous FAS system in the wild-type plants (i.e., wild-type plants produce some shorter or medium chain PUFAs, such as 18 carbon PUFAs, via the FAS system, but there will be new, or additional, fatty acids produced in the plant as a result of genetic modification with a PUFA PKS system). In other words, as compared to the profile of total fatty acids from the wild-type plant (not genetically modified) or the parent plant used as a recipient for the indicated genetic modification, the majority of additional fatty acids (new fatty acids or increased fatty acids resulting from the genetic modification) in the profile of total fatty acids produced by plants that have been genetically modified with a PUFA PKS system, comprise the target or intended PUFA products of the PUFA PKS system (i.e., the majority of additional, or new, fatty acids in the total fatty acids that are produced by the genetically modified plant are the target PUFA(s)).

Furthermore, to be "substantially free" of intermediate or side products of the system for synthesizing PUFAs, or to not have intermediate or side products present in substantial amounts, means that any intermediate or side product fatty acids (non-target PUFAs) that are produced in the genetically modified plant (and/or parts of plants and/or seed oil fraction) as a result of the introduction or presence of the enzyme system for producing PUFAs (i.e., that are not produced by the wild-type plant or the parent plant used as a recipient for the indicated genetic modification), are present in a quantity that is less than about 10% by weight of the total fatty acids produced by the plant, and more preferably less than about 9%, and more preferably less than about 8%, and more preferably less than about 7%, and more preferably less than about 6%, and more preferably less than about 5%, and more preferably less than about 4%, and more preferably less than about 3%, and more preferably less than about 2%, and more preferably less than about 1% by weight of the total fatty acids produced by the plant, and more preferably less than about 0.5% by weight of the total fatty acids produced by the plant.

In a preferred embodiment, to be "substantially free" of intermediate or side products of the system for synthesizing PUFAs, or to not have intermediate or side products present in substantial amounts, means that any intermediate or side product fatty acids that are produced in the genetically modified plant (and/or parts of plants and/or in seed oil fraction) as a result of the enzyme system for producing PUFAS (i.e., that are not produced by the wild-type plant or by the parent plant used as a recipient for the indicated genetic modification for production of target PUFAs), are present in a quantity that is less than about 10% by weight of the total additional fatty acids produced by the plant (additional fatty acids being defined as those fatty acids or levels of fatty acids that are not naturally produced by the wild-type plant or by the parent plant that is used as a recipient for the indicated genetic modification for production of target PUFAs), and more preferably less than about 9%, and more preferably less than about 8%, and more preferably less than about 7%, and more preferably less than about 6%, and more preferably less than about 5%, and more preferably less than about 4%, and more preferably less than about 3%, and more preferably less than about 2%, and more preferably less than about 1% of the total additional fatty acids produced by the plant. Therefore, in contrast to the fatty acid profile of plants that have been genetically modified to produce PUFAs via the standard pathway, the majority of fatty acid products resulting from the genetic modification with a PUFA PKS system will be the target or intended fatty acid products.

When the target product of a PUFA PKS system is a long chain PUFA, such as DHA, DPA (n-6 or n-3), or EPA, intermediate products and side products that are not present in substantial amounts in the total lipids of plants genetically modified with such PUFA PKS can include, but are not limited to: gamma-linolenic acid (GLA; 18:3, n-6); stearidonic acid (STA or SDA; 18:4, n-3); dihomo-gamma-linolenic acid (DGLA or HGLA; 20:3, n-6), arachidonic acid (ARA, C20:4, n-6); eicosatrienoic acid (ETA; 20:3, n-9) and various other intermediate or side products, such as 20:0; 20:1 (Δ5); 20:1 (Δ11); 20:2 (Δ8,11); 20:2 (Δ11,14); 20:3 (Δ5,11,14); 20:3 (Δ11,14,17); mead acid (20:3; Δ5,8,11); or 20:4 (Δ5,1,14,17). In addition, when the target product is a particular PUFA, such as DHA, the intermediate products and side products that are not present in substantial amounts in the total lipids of the genetically modified plants also include other PUFAs, including other PUFAs that are a natural product of a different PUFA PKS system, such as EPA in this example. It is to be noted that the PUFA PKS system of the present invention can also be used, if desired, to produce as a target PUFA a PUFA that can include GLA, SDA or DGLA.

Using the knowledge of the genetic basis and domain structure of PUFA PKS systems as described herein, the present inventors have designed and produced constructs encoding such a PUFA PKS system and have successfully produced transgenic plants expressing the PUFA PKS system. The transgenic plants produce oils containing PUFAs, and the oils are substantially free of intermediate products that accumulate in a standard PUFA pathway. The present inventors have also demonstrated the use of the constructs to produce PUFAs in another eukaryote, yeast, as a proof-of-concept experiment prior to the production of the transgenic plants. The examples demonstrate that transformation of both yeast and plants with a PUFA PKS system that produces DHA and DPAn-6 as the target PUFAs produces both of these PUFAs as the primary additional fatty acids in the total fatty acids of the plant (i.e., subtracting fatty acids that are produced in the wild-type plant), and in the yeast and further, that any other fatty acids that are not present in the fatty acids of the wild-type plant or parent plant are virtually undetectable. Specific characteristics of genetically modified plants and parts and oils thereof of the present invention are described in detail below.

According to the present invention, a genetically modified plant includes a plant that has been modified using recombinant technology, which may be combined with classical mutagenesis and screening techniques. As used herein, genetic modifications that result in a decrease in gene expression, in the function of the gene, or in the function of the gene product (i.e., the protein encoded by the gene) can be referred to as inactivation (complete or partial), deletion, interruption, blockage or down-regulation of a gene. For example, a genetic modification in a gene which results in a decrease in the function of the protein encoded by such gene, can be the result of a complete deletion of the gene (i.e., the gene does not exist, and therefore the protein does not exist), a mutation in the gene which results in incomplete or no translation of the protein (e.g., the protein is not expressed), or a mutation in the gene which decreases or abolishes the natural function of the protein (e.g., a protein is expressed which has decreased or no enzymatic activity or action). Genetic modifications that result in an increase in gene expression or function can be referred to as amplification, overproduction, overexpression, activation, enhancement, addition, or up-regulation of a gene.

The genetic modification of a plant according to the present invention results in the production of one or more PUFAs by the plant. The PUFA profile and the ratio of the PUFAs produced by the plant is not necessarily the same as the PUFA profile or ratio of PUFAs produced by the organism from which the PUFA PKS system was derived.

With regard to the production of genetically modified plants, methods for the genetic engineering of plants are also well known in the art. For instance, numerous methods for plant transformation have been developed, including biological and physical transformation protocols for dicotelydenous plants as well as monocotelydenous plants (e.g. Goto-Fumiyuki et al., 1999, *Nature Biotech* 17: 282-286). See, for example, Miki et al., "Procedures for Introducing Foreign DNA into Plants" in Methods in Plant Molecular Biology and Biotechnology, Glick, B. R. and Thompson, J. E. Eds. (CRC Press, Inc., Boca Raton, 1993) pp. 67-88. In addition, vectors and in vitro culture methods for plant cell or tissue transformation and regeneration of plants are available. See, for example, Gruber et al., "Vectors for Plant Transformation" in Methods in Plant Molecular Biology and Biotechnology, Glick, B. R. and Thompson, J. E. Eds. (CRC Press, Inc., Boca Raton, 1993) pp. 89-119.

The most widely utilized method for introducing an expression vector into plants is based on the natural transformation system of *Agrobacterium*. See, for example, Horsch et al., Science 227:1229 (1985). *A. tumefaciens* and *A. rhizogenes* are plant pathogenic soil bacteria which genetically transform plant cells. The Ti and Ri plasmids of *A. tumefaciens* and *A. rhizogenes*, respectively, carry genes responsible for genetic transformation of the plant. See, for example, Kado, C. I., Crit. Rev. Plant. Sci. 10:1 (1991). Descriptions of *Agrobacterium* vector systems and methods for *Agrobacterium*-mediated gene transfer are provided by numerous references, including Gruber et al., supra, Miki et al., supra, Moloney et al., Plant Cell Reports 8:238 (1989), and U.S. Pat. Nos. 4,940,838 and 5,464,763.

Another generally applicable method of plant transformation is microprojectile-mediated transformation wherein DNA is carried on the surface of microprojectiles. The expression vector is introduced into plant tissues with a biolistic device that accelerates the microprojectiles to speeds sufficient to penetrate plant cell walls and membranes. Sanford et al., Part. Sci. Technol. 5:27 (1987), Sanford, J. C., Trends Biotech. 6:299 (1988), Sanford, J. C., Physiol. Plant 79:206 (1990), Klein et al., Biotechnology 10:268 (1992).

Another method for physical delivery of DNA to plants is sonication of target cells. Zhang et al., *Bio/Technology* 9:996 (1991). Alternatively, liposome or spheroplast fusion have been used to introduce expression vectors into plants. Deshayes et al., EMBO J., 4:2731 (1985), Christou et al., Proc Natl. Acad. Sci. USA 84:3962 (1987). Direct uptake of DNA into protoplasts using CaCl2 precipitation, polyvinyl alcohol or poly-L-ornithine have also been reported. Hain et al., Mol. Gen. Genet. 199:161 (1985) and Draper et al., Plant Cell Physiol. 23:451 (1982). Electroporation of protoplasts and whole cells and tissues have also been described. Donn et al., In Abstracts of VIIth International Congress on Plant Cell and Tissue Culture IAPTC, A2-38, p. 53 (1990); D'Halluin et al., Plant Cell 4:1495-1505 (1992) and Spencer et al., Plant Mol. Biol. 24:51-61 (1994). Additionally, silicone carbide whiskers (Kaepler et al., 1990, Plant Cell Reports) and in plant transformation using, for example, a flower dipping methodology, (Clough and Bent, 1998, Plant J. 16: 735-743) may be used.

The exact plant transformation methodology may vary somewhat depending on the plant species selected and the plant cell type selected for transformation (e.g. seedling derived cell types such as hypocotyls and cotelydons or embryonic tissue.

As hereinbefore mentioned in one embodiment the plant selected is safflower. A methodology to obtain safflower transformants has been described in Baker and Dyer (Plant Cell Reports, 1996, 16: 106-110).

Following the introduction of the genetic construct into plant cells, plant cells are grown and upon emergence of differentiating tissue such as shoots and roots, mature plants are generated. Typically a plurality of plants is generated Methodologies for regenerating plants will be generally known to those skilled in the art and may be found in for example: Plant Cell and Tissue Culture, 1994, Vasil and Thorpe Eds. Kluwer Academic Publishers and in: Plant Cell Culture Protocols (Methods in Molecular Biology 111, 1999 Hall Eds Humana Press).

Accordingly, encompassed by the present invention are methods to genetically modify plant cells by making use of genes from certain marine bacterial and any thraustochytrid or other eukaryotic PUFA PKS systems, and further can utilize gene mixing to extend and/or alter the range of PUFA products to include EPA, DHA, DPA (n-3 or n-6), ARA, GLA, SDA and others. The method to obtain these altered PUFA production profiles includes not only the mixing of genes from various organisms into the thraustochytrid PUFA PKS genes, but also various methods of genetically modifying the endogenous thraustochytrid PUFA PKS genes disclosed herein. Knowledge of the genetic basis and domain structure of the thraustochytrid PUFA PKS system and the marine bacterial PUFA PKS system provides a basis for designing novel genetically modified organisms that produce a variety of PUFA profiles. Novel PUFA PKS constructs prepared in microorganisms such as a thraustochytrid or in *E. coli* can be isolated and used to transform plants to impart similar PUFA production properties onto the plants. Detailed discussions of particular modifications of PUFA PKS systems that are encompassed by the present invention are set forth, for example, in U.S. Patent Application Publication No.

20020194641; U.S. Patent Application Publication No. 20040235127; and U.S. Patent Application Publication No. 20050100995).

A genetically modified plant is preferably cultured in a fermentation medium or grown in a suitable medium such as soil. An appropriate, or effective, fermentation medium has been discussed in detail above. A suitable growth medium for higher plants includes any growth medium for plants, including, but not limited to, soil, sand, any other particulate media that support root growth (e.g. vermiculite, perlite, etc.) or hydroponic culture, as well as suitable light, water and nutritional supplements which optimize the growth of the higher plant. The genetically modified plants of the present invention are engineered to produce PUFAs through the activity of the PUFA PKS system. The PUFAs can be recovered through purification processes which extract the compounds from the plant. In a preferred embodiment, the PUFAs are recovered by harvesting the plant. In a particularly preferred embodiment, the PUFAs are recovered by harvesting the oil from the plant (e.g., from the oil seeds). The plant can also be consumed in its natural state or further processed into consumable products.

Preferably, a genetically modified plant of the invention produces one or more polyunsaturated fatty acids including, but not limited to, EPA (C20:5, n-3), DHA (C22:6, n-3), DPA (C22:5, n-6 or n-3), ARA (C20:4, n-6), GLA (C18:3, n-6), ALA (C18:3, n-3), and/or SDA (C18:4, n-3)), and more preferably, one or more long chain fatty acids (LCPUFAs), including, but not limited to, EPA (C20:5, n-3), DHA (C22:6, n-3), DPA (C22:5, n-6 or n-3), or DTA (C22:4, n-6). In a particularly preferred embodiment, a genetically modified plant of the invention produces one or more polyunsaturated fatty acids including, but not limited to, EPA (C20:5, n-3), DHA (C22:6, n-3), and/or DPA (C22:5, n-6 or n-3).

Accordingly, one embodiment of the present invention relates to a plant, and preferably an oil seed plant, wherein the plant produces (e.g., in its mature seeds, if an oil seed plant, or in the oil of the seeds of an oil seed plant) at least one PUFA (the target PUFA), and wherein the total fatty acid profile in the plant, or the part of the plant that accumulates PUFAs (e.g., mature seeds, if the plant is an oil seed plant or the oil of the seeds of an oil seed plant), comprises a detectable amount of this PUFA or PUFAs. Preferably, the target PUFA is at least a 20 carbon PUFA and comprises at least 3 double bonds, and more preferably at least 4 double bonds, and even more preferably, at least 5 double bonds. Furthermore, the target PUFA is preferably a PUFA that is not naturally produced by the plant (i.e., the wild-type plant in the absence of genetic modification or the parent plant used as a recipient for the indicated genetic modification). Preferably, the total fatty acid profile in the plant or in the part of the plant that accumulates PUFAs (including the seed oil of the plant) comprises at least 0.1% of the target PUFA(s) by weight of the total fatty acids, and more preferably at least about 0.2%, and more preferably at least about 0.3%, and more preferably at least about 0.4%, and more preferably at least about 0.5%, and more preferably at least about 1%, and more preferably at least about 1.5%, and more preferably at least about 2%, and more preferably at least about 2.5%, and more preferably at least about 3%, and more preferably at least about 3.5%, and more preferably at least about 4%, and more preferably at least about 4.5%, and more preferably at least about 5%, and more preferably at least about 5.5%, and more preferably at least about 10%, and more preferably at least about 15%, and more preferably at least about 20%, and more preferably at least about 25%, and more preferably at least about 30%, and more preferably at least about 35%, and more preferably at least about 40%, and more preferably at least about 45%, and more preferably at least about 50%, and more preferably at least about 55%, and more preferably at least about 60%, and more preferably at least about 65%, and more preferably at least about 70%, and more preferably at least about 75%, and more preferably more that 75% of at least one polyunsaturated fatty acid (the target PUFA or PUFAs) by weight of the total fatty acids produced by the plant, or any percentage from 0.1% to 75%, or greater than 75% (up to 100% or about 100%), in 0.1% increments, of the target PUFA(s). As generally used herein, reference to a percentage amount of PUFA production is by weight of the total fatty acids produced by the organism (plant), unless otherwise stated (e.g., in some cases, percentage by weight is relative to the total fatty acids produced by an enzyme complex, such as a PUFA PKS system). In one embodiment, total fatty acids produced by a plant are presented as a weight percent as determined by gas chromatography (GC) analysis of a fatty acid methyl ester (FAME) preparation, although determination of total fatty acids is not limited to this method.

As described above, it is an additional characteristic of the total fatty acids produced by the above-described plant (and/or parts of plants or seed oil fraction) that these total fatty acids produced by the plant comprise less than (or do not contain any more than) about 10% by weight of any fatty acids, other than the target PUFA(s) that are produced by the enzyme complex that produces the target PUFA(s). Preferably, any fatty acids that are produced by the enzyme complex that produces the target PUFA(s) (e.g., as a result of genetic modification of the plant with the enzyme or enzyme complex that produces the target PUFA(s)), other than the target PUFA(s), are present at less than about 9%, and more preferably less than about 8%, and more preferably less than about 7%, and more preferably less than about 6%, and more preferably less than about 5%, and more preferably less than about 4%, and more preferably less than about 3%, and more preferably less than about 2%, and more preferably less than about 1% by weight of the total fatty acids produced by the plant.

In another embodiment, any fatty acids that are produced by the enzyme complex that produces the target PUFA(s) other than the target PUFA(s) are present at less than (or do not contain any more than) about 10% by weight of the total fatty acids that are produced by the enzyme complex that produces the target PUFA(s) in the plant (i.e., this measurement is limited to those total fatty acids that are produced by the enzyme complex that produces the target PUFAs), and more preferably less than about 9%, and more preferably less than about 8%, and more preferably less than about 7%, and more preferably less than about 6%, and more preferably less than about 5%, and more preferably less than about 4%, and more preferably less than about 3%, and more preferably less than about 2%, and more preferably less than about 1% by weight of the total fatty acids, and more preferably less than about 0.5% by weight of the total fatty acids that are produced by the enzyme complex that produces the target PUFA(s) in the plant.

In another aspect of this embodiment of the invention, the total fatty acids produced by the plant (and/or parts of plants or seed oil fraction) contain less than (or do not contain any more than) 10% PUFAs having 18 or more carbons by weight of the total fatty acids produced by the plant, other than the target PUFA(s) or the PUFAs that are present in the wild-type plant (not genetically modified) or in the parent plant used as a recipient for the indicated genetic modification. In further aspects, the total fatty acids produced by the plant (and/or parts of plants or seed oil fraction) contain less than 9% PUFAs having 18 or more carbons, or less than 8% PUFAs having 18 or more carbons, or less than 7% PUFAs having 18 or more carbons, or less than 6% PUFAs having 18 or more carbons, or less than 5% PUFAs having 18 or more carbons, or less than 4% PUFAs having 18 or more carbons, or less than 3% PUFAs having 18 or more carbons, or less than 2% PUFAs having 18 or more carbons, or less than 1% PUFAs having 18 or more carbons by weight of the total fatty acids produced by the plant, other than the target PUFA(s) or the PUFAs that are present in the wild-type plant (not genetically modified) or the parent plant used as a recipient for the indicated genetic modification.

In another aspect of this embodiment of the invention, the total fatty acids produced by the plant (and/or parts of plants or seed oil fraction) contain less than (or do not contain any more than) 10% PUFAs having 20 or more carbons by weight of the total fatty acids produced by the plant, other than the target PUFA(s) or the PUFAs that are present in the wild-type plant (not genetically modified) or the parent plant used as a recipient for the indicated genetic modification. In further aspects, the total fatty acids produced by the plant (and/or parts of plants or seed oil fraction) contain less than 9% PUFAs having 20 or more carbons, or less than 8% PUFAs having 20 or more carbons, or less than 7% PUFAs having 20 or more carbons, or less than 6% PUFAs having 20 or more carbons, or less than 5% PUFAs having 20 or more carbons, or less than 4% PUFAs having 20 or more carbons, or less than 3% PUFAs having 20 or more carbons, or less than 2% PUFAs having 20 or more carbons, or less than 1% PUFAs having 20 or more carbons by weight of the total fatty acids produced by the plant, other than the target PUFA(s) or the PUFAs that are present in the wild-type plant (not genetically modified) or the parent plant used as a recipient for the indicated genetic modification.

In one embodiment, the total fatty acids in the plant (and/or parts of plants or seed oil fraction) contain less than about 10% by weight of the total fatty acids produced by the plant, and more preferably less than about 9%, and more preferably less than about 8%, and more preferably less than about 7%, and more preferably less than about 6%, and more preferably less than about 5%, and more preferably less than about 4%, and more preferably less than about 3%, and more preferably less than about 2%, and more preferably less than about 1% of a fatty acid selected from any one or more of: gamma-linolenic acid (GLA; 18:3, n-6); stearidonic acid (STA or SDA; 18:4, n-3); dihomo-gamma-linolenic acid (DGLA or HGLA; 20:3, n-6), arachidonic acid (ARA, C20:4, n-6); eicosatrienoic acid (ETA; 20:3, n-9) and various other fatty acids, such as 20:0; 20:1 ($\Delta$5); 20:1 ($\Delta$11); 20:2 ($\Delta$8,11); 20:2 ($\Delta$11,14); 20:3 ($\Delta$5,11,14); 20:3 ($\Delta$11,14,17); mead acid (20:3; $\Delta$5,8,11); or 20:4 ($\Delta$5,1,14,17).

In another embodiment, the fatty acids that are produced by the enzyme system that produces the long chain PUFAs in the plant contain less than about 10% by weight of a fatty acid selected from: gamma-linolenic acid (GLA; 18:3, n-6); stearidonic acid (STA or SDA; 18:4, n-3); dihomo-gamma-linolenic acid (DGLA or HGLA; 20:3, n-6), arachidonic acid (ARA, C20:4, n-6); eicosatrienoic acid (ETA; 20:3, n-9) and various other fatty acids, such as 20:0; 20:1 ($\Delta$5); 20:1 ($\Delta$11); 20:2 ($\Delta$8,11); 20:2 ($\Delta$11,14); 20:3 ($\Delta$5,11,14); 20:3 ($\Delta$11,14,17); mead acid (20:3; $\Delta$5,8,1); or 20:4 ($\Delta$5,1,14,17), as a percentage of the total fatty acids produced by the plant, and more preferably less than about 9%, and more preferably less than about 8%, and more preferably less than about 7%, and more preferably less than about 6%, and more preferably less than about 5%, and more preferably less than about 4%, and more preferably less than about 3%, and more preferably less than about 2%, and more preferably less than about 1% of a fatty acid selected from: gamma-linolenic acid (GLA; 18:3, n-6); stearidonic acid (STA or SDA; 18:4, n-3); dihomo-gamma-linolenic acid (DGLA or HGLA; 20:3, n-6), arachidonic acid (ARA, C20:4, n-6); eicosatrienoic acid (ETA; 20:3, n-9) and various other fatty acids, such as 20:0; 20:1 ($\Delta$5); 20:1 ($\Delta$11); 20:2 ($\Delta$8,11); 20:2 ($\Delta$11,14); 20:3 ($\Delta$5,11,14); 20:3 ($\Delta$11,14,17); mead acid (20:3; $\Delta$5,8,11); or 20:4 ($\Delta$5,1,14,17).

In another embodiment, the fatty acids that are produced by the enzyme system that produces the long chain PUFAs in the plant contain less than about 10% by weight of all of the following PUFAs: gamma-linolenic acid (GLA; 18:3, n-6), PUFAs having 18 carbons and four carbon-carbon double bonds, PUFAs having 20 carbons and three carbon-carbon double bonds, and PUFAs having 22 carbons and two or three carbon-carbon double bonds, as a percentage of the total fatty acids produced by the plant, and more preferably less than about 9%, and more preferably less than about 8%, and more preferably less than about 7%, and more preferably less than about 6%, and more preferably less than about 5%, and more preferably less than about 4%, and more preferably less than about 3%, and more preferably less than about 2%, and more preferably less than about 1% of all of the following PUFAs: gamma-linolenic acid (GLA; 18:3, n-6), PUFAs having 18 carbons and four carbon-carbon double bonds, PUFAs having 20 carbons and three carbon-carbon double bonds, and PUFAs having 22 carbons and two or three carbon-carbon double bonds.

In another embodiment, the fatty acids that are produced by the enzyme system that produces the long chain PUFAs in the plant contain less than about 10% by weight of each of the following PUFAs: gamma-linolenic acid (GLA; 18:3, n-6), PUFAs having 18 carbons and four carbon-carbon double bonds, PUFAs having 20 carbons and three carbon-carbon double bonds, and PUFAs having 22 carbons and two or three carbon-carbon double bonds, as a percentage of the total fatty acids produced by the plant, and more preferably less than about 9%, and more preferably less than about 8%, and more preferably less than about 7%, and more preferably less than about 6%, and more preferably less than about 5%, and more preferably less than about 4%, and more preferably less than about 3%, and more preferably less than about 2%, and more preferably less than about 1% of each of the following PUFAs: gamma-linolenic acid (GLA; 18:3, n-6), PUFAs having 18 carbons and four carbon-carbon double bonds, PUFAs having 20 carbons and three carbon-carbon double bonds, and PUFAs having 22 carbons and two or three carbon-carbon double bonds.

In another embodiment, the fatty acids that are produced by the enzyme system that produces the long chain PUFAs in the plant contain less than about 10% by weight of any one or more of the following PUFAs: gamma-linolenic acid (GLA; 18:3, n-6), PUFAs having 18 carbons and four carbon-carbon double bonds, PUFAs having 20 carbons and three carbon-carbon double bonds, and PUFAs having 22 carbons and two or three carbon-carbon double bonds, as a percentage of the total fatty acids produced by the plant, and more preferably less than about 9%, and more preferably less than about 8%, and more preferably less than about 7%, and more preferably less than about 6%, and more preferably less than about 5%, and more preferably less than about 4%, and more preferably less than about 3%, and more preferably less than about 2%, and more preferably less than about 1% of any one or more of the following PUFAs: gamma-linolenic acid (GLA; 18:3, n-6), PUFAs having 18 carbons and four carbon-carbon double bonds, PUFAs having 20 carbons and three carbon-carbon double bonds, and PUFAs having 22 carbons and two or three carbon-carbon double bonds.

In one aspect of this embodiment of the invention, the plant produces at least two target PUFAs, and the total fatty acid profile in the plant, or the part of the plant that accumulates PUFAs (including oils from the oil seeds), comprises a detectable amount of these PUFAs. In this embodiment, the PUFAs are preferably each at least a 20 carbon PUFA and comprise at least 3 double bonds, and more preferably at least 4 double bonds, and even more preferably, at least 5 double bonds. Such PUFAs are most preferably chosen from DHA, DPAn-6 and EPA. In one aspect, the plant produces DHA and DPAn-6, and the ratio of DHA to DPAn-6 is from about 1:10 to about 10:1, including any ratio in between. In a one embodiment, the ratio of DHA to DPA is from about 1:1 to about 3:1, and in another embodiment, about 2.5:1. In one embodiment, the plant produces DHA and EPA.

In another aspect of this embodiment of the invention, the plant produces the total fatty acid profile represented by FIG. 13 or FIG. 14.

The invention further includes any seeds produced by the plants described herein, as well as any oils produced by the plants or seeds described herein. The invention also includes any products produced using the plants, seed or oils described herein.

Uses for Genetically Modified Organisms of the Invention

One embodiment of the present invention is a method to produce desired bioactive molecules (also referred to as products or compounds) by growing or culturing a genetically modified organism (e.g., a microorganism or a plant) of the present invention (described in detail above). Preferably, the bioactive molecule is a PUFA, and most preferably, an LCPUFA. Preferably, the genetically modified organism is a genetically modified microorganism or a genetically modified plant. Such a method includes, for example, the step of culturing in a fermentation medium or growing in a suitable environment, such as soil, a microorganism or plant, respectively, that has a genetic modification as described previously herein and in accordance with the present invention. Preferred host cells and organisms for genetic modification related to the PUFA PKS system of the invention are described above.

One embodiment of the present invention is a method to produce desired PUFAs by culturing a genetically modified microorganism of the present invention (described in detail above). Such a method includes the step of culturing in a fermentation medium and under conditions effective to produce the PUFA(s) a microorganism that has a genetic modification as described previously herein and in accordance with the present invention. An appropriate, or effective, medium refers to any medium in which a genetically modified microorganism of the present invention, when cultured, is capable of producing the desired PUFA product(s). Such a medium is typically an aqueous medium comprising assimilable carbon, nitrogen and phosphate sources. Such a medium can also include appropriate salts, minerals, metals and other nutrients. Any microorganisms of the present invention can be cultured in conventional fermentation bioreactors. The microorganisms can be cultured by any fermentation process which includes, but is not limited to, batch, fed-batch, cell recycle, and continuous fermentation. Preferred growth conditions for Thraustochytrid microorganisms according to the present invention are well known in the art and are described in detail, for example, in U.S. Pat. No. 5,130,242, U.S. Pat. No. 5,340,742, and U.S. Pat. No. 5,698,244, each of which is incorporated herein by reference in its entirety.

The desired PUFA(s) and/or other bioactive molecules produced by the genetically modified microorganism can be recovered from the fermentation medium using conventional separation and purification techniques. For example, the fermentation medium can be filtered or centrifuged to remove microorganisms, cell debris and other particulate matter, and the product can be recovered from the cell-free supernatant by conventional methods, such as, for example, ion exchange, chromatography, extraction, solvent extraction, phase separation, membrane separation, electrodialysis, reverse osmosis, distillation, chemical derivatization and crystallization. Alternatively, microorganisms producing the PUFA(s), or extracts and various fractions thereof, can be used without removal of the microorganism components from the product.

Preferably, PUFAs are produced in an amount that is greater than about 5% of the dry weight of the microorganism, and in one aspect, in an amount that is greater than 6%, and in another aspect, in an amount that is greater than 7%, and in another aspect, in an amount that is greater than 8%, and in another aspect, in an amount that is greater than 9%, and in another aspect, in an amount that is greater than 10%, and so on in whole integer percentages, up to greater than 90% dry weight of the microorganism (e.g., 15%, 20%, 30%, 40%, 50%, and any percentage in between).

Preferably, bioactive compounds of interest are produced by the genetically modified microorganism in an amount that is greater than about 0.05%, and preferably greater than about 0.1%, and more preferably greater than about 0.25%, and more preferably greater than about 0.5%, and more preferably greater than about 0.75%, and more preferably greater than about 1%, and more preferably greater than about 2.5%, and more preferably greater than about 5%, and more preferably greater than about 10%, and more preferably greater than about 15%, and even more preferably greater than about 20% of the dry weight of the microorganism. For lipid compounds, preferably, such compounds are produced in an amount that is greater than about 5% of the dry weight of the microorganism. For other bioactive compounds, such as antibiotics or compounds that are synthesized in smaller amounts, those strains possessing such compounds at of the dry weight of the microorganism are identified as predictably containing a novel PKS system of the type described above. In some embodiments, particular bioactive molecules (compounds) are secreted by the microorganism, rather than accumulating. Therefore, such bioactive molecules are generally recovered from the culture medium and the concentration of molecule produced will vary depending on the microorganism and the size of the culture.

In the method for production of desired bioactive compounds of the present invention, a genetically modified plant is cultured in a fermentation medium or grown in a suitable medium such as soil. An appropriate, or effective, fermentation medium has been discussed in detail above. A suitable growth medium for higher plants includes any growth medium for plants, including, but not limited to, soil, sand, any other particulate media that support root growth (e.g. vermiculite, perlite, etc.) or hydroponic culture, as well as suitable light, water and nutritional supplements which optimize the growth of the higher plant. The genetically modified plants of the present invention are engineered to produce significant quantities of the desired product through the activity of the PUFA PKS system and other heterologous proteins (accessory proteins to the PUFA PKS system) according to the present invention. The compounds can be recovered through purification processes which extract the compounds from the plant. In a preferred embodiment, the compound is recovered by harvesting the plant. In this embodiment, the plant can be consumed in its natural state or further processed into consumable products.

The invention further includes any organisms or parts thereof described herein (e.g., microorganisms and preparations or fractions thereof or plants, parts of the plants (e.g., oil seeds), or preparations or fractions thereof), as well as any oils produced by the organisms described herein. The invention also includes any products produced using the organisms, parts thereof, or oils described herein.

One embodiment of the present invention relates to a method to modify a product containing at least one fatty acid, comprising adding to the product an organism, part thereof, or oil produced by a genetically modified organism according to the invention and as described herein (e.g., a plant or microorganism that has been genetically modified with a PUFA PKS system, makes use of any of the strategies for improvement of production and/or accumulation of PUFAs described herein, and has a fatty acid profile described herein). Any products produced by this method or generally containing any organisms, parts thereof, or oils from the organisms described herein are also encompassed by the invention.

Preferably, the product is selected from the group consisting of a food, a dietary supplement, a pharmaceutical formulation, a humanized animal milk, and an infant formula. Suitable pharmaceutical formulations include, but are not limited to, an anti-inflammatory formulation, a chemotherapeutic agent, an active excipient, an osteoporosis drug, an anti-depressant, an anti-convulsant, an anti-*Heliobactor pylori* drug, a drug for treatment of neurodegenerative disease, a drug for treatment of degenerative liver disease, an antibiotic, and a cholesterol lowering formulation. In one embodiment, the product is used to treat a condition selected from the group consisting of: chronic inflammation, acute inflammation, gastrointestinal disorder, cancer, cachexia, cardiac restenosis, neurodegenerative disorder, degenerative disorder of the liver, blood lipid disorder, osteoporosis, osteoarthritis, autoimmune disease, preeclampsia, preterm birth, age related maculopathy, pulmonary disorder, and peroxisomal disorder.

Suitable food products include, but are not limited to, fine bakery wares, bread and rolls, breakfast cereals, processed and unprocessed cheese, condiments (ketchup, mayonnaise, etc.), dairy products (milk, yogurt), puddings and gelatine desserts, carbonated drinks, teas, powdered beverage mixes, processed fish products, fruit-based drinks, chewing gum, hard confectionery, frozen dairy products, processed meat products, nut and nut-based spreads, pasta, processed poultry products, gravies and sauces, potato chips and other chips or crisps, chocolate and other confectionery, soups and soup mixes, soya based products (milks, drinks, creams, whiteners), vegetable oil-based spreads, and vegetable-based drinks.

GENERAL DEFINITIONS AND GUIDANCE

According to the present invention, an isolated protein is a protein or a fragment thereof (including a polypeptide or peptide) that has been removed from its natural milieu (i.e., that has been subject to human manipulation) and can include purified proteins, partially purified proteins, recombinantly produced proteins, and synthetically produced proteins, for example. As such, "isolated" does not reflect the extent to which the protein has been purified. Preferably, an isolated protein of the present invention is produced recombinantly. An isolated peptide can be produced synthetically (e.g., chemically, such as by peptide synthesis) or recombinantly.

As used herein, the term "lipid" includes phospholipids; free fatty acids; esters of fatty acids; triacylglycerols; diacylglycerides; monoacylglycerides; lysophospholipids; soaps; phosphatides; waxes (esters of alcohols and fatty acids); sterols and sterol esters; carotenoids; xanthophylls (e.g., oxycarotenoids); hydrocarbons; and other lipids known to one of ordinary skill in the art. The terms "polyunsaturated fatty acid" and "PUFA" include not only the free fatty acid form, but other forms as well, such as the TAG form and the PL form.

Reference to a particular protein from a specific organism or to a particular protein being derived from a specific organism, such as a "*Schizochytrium* ACoAS" or an "ACoAS derived from *Schizochytrium*", by way of example, refers to an ACoAS (including a homologue of the naturally occurring ACoAS) from a *Schizochytrium* or an ACoAS that has been otherwise produced from the knowledge of the structure (e.g., sequence) of a naturally occurring ACoAS from *Schizochytrium*. In other words, a *Schizochytrium* ACoAS includes any ACoAS that has the structure and function of a naturally occurring ACoAS from *Schizochytrium* or that has a structure and function that is sufficiently similar to a *Schizochytrium* ACoAS such that the ACoAS is a biologically active (i.e., has biological activity) homologue of a naturally occurring ACoAS from *Schizochytrium*. As such, a *Schizochytrium* ACoAS can include purified, partially purified, recombinant, mutated/modified and synthetic proteins.

According to the present invention, the terms "modification" and "mutation" can be used interchangeably, particularly with regard to the modifications/mutations to the primary amino acid sequences of a protein or peptide (or nucleic acid sequences) described herein. The term "modification" can also be used to describe post-translational modifications to a protein or peptide including, but not limited to, methylation, farnesylation, carboxymethylation, geranyl geranylation, glycosylation, phosphorylation, acetylation, myristoylation, prenylation, palmitation, and/or amidation. Modifications can also include, for example, complexing a protein or peptide with another compound. Such modifications can be considered to be mutations, for example, if the modification is different than the post-translational modification that occurs in the natural, wild-type protein or peptide.

As used herein, the term "homologue" is used to refer to a protein or peptide which differs from a naturally occurring protein or peptide (i.e., the "prototype" or "wild-type" protein) by one or more minor modifications or mutations to the naturally occurring protein or peptide, but which maintains the overall basic protein and side chain structure of the naturally occurring form (i.e., such that the homologue is identifiable as being related to the wild-type protein). Such changes include, but are not limited to: changes in one or a few (e.g., 1% or less) amino acid side chains; changes one or a few (e.g., 1% or less) amino acids, including deletions (e.g., a truncated version of the protein or peptide) insertions and/or substitutions; changes in stereochemistry of one or a few (e.g., 1% or less) atoms; and/or minor derivatizations, including but not limited to: methylation, farnesylation, geranyl geranylation, glycosylation, carboxymethylation, phosphorylation, acetylation, myristoylation, prenylation, palmitation, and/or amidation. A homologue can have either enhanced, decreased, or substantially similar properties as compared to the naturally occurring protein or peptide. Preferred homologues of a protein are described in detail below. It is noted that homologues can include synthetically produced homologues, naturally occurring allelic variants of a given protein or domain thereof, or homologous sequences from organisms other than the organism from which the reference sequence was derived.

Conservative substitutions typically include substitutions within the following groups: glycine and alanine; valine, isoleucine and leucine; aspartic acid, glutamic acid, asparagine, and glutamine; serine and threonine; lysine and arginine; and phenylalanine and tyrosine. Substitutions may also be made on the basis of conserved hydrophobicity or hydrophilicity (Kyte and Doolittle, *J. Mol. Biol.* 157:105 (1982)), or on the basis of the ability to assume similar polypeptide secondary structure (Chou and Fasman, *Adv. Enzymol.* 47: 45 (1978)).

Homologues can be the result of natural allelic variation or natural mutation. A naturally occurring allelic variant of a nucleic acid encoding a protein is a gene that occurs at essentially the same locus (or loci) in the genome as the gene which encodes such protein, but which, due to natural variations caused by, for example, mutation or recombination, has a similar but not identical sequence. Allelic variants typically encode proteins having similar activity to that of the protein encoded by the gene to which they are being compared. One class of allelic variants can encode the same protein but have different nucleic acid sequences due to the degeneracy of the genetic code. Allelic variants can also comprise alterations in the 5' or 3' untranslated regions of the gene (e.g., in regulatory control regions). Allelic variants are well known to those skilled in the art.

Homologues can be produced using techniques known in the art for the production of proteins including, but not limited to, direct modifications to the isolated, naturally occurring protein, direct protein synthesis, or modifications to the nucleic acid sequence encoding the protein using, for example, classic or recombinant DNA techniques to effect random or targeted mutagenesis.

Modifications or mutations in protein homologues, as compared to the wild-type protein, either increase, decrease, or do not substantially change, the basic biological activity of the homologue as compared to the naturally occurring (wild-type) protein. In general, the biological activity or biological action of a protein refers to any function(s) exhibited or performed by the protein that is ascribed to the naturally occurring form of the protein as measured or observed in vivo (i.e., in the natural physiological environment of the protein) or in vitro (i.e., under laboratory conditions). Biological activities of PUFA PKS systems and the individual proteins/domains that make up a PUFA PKS system have been described in detail elsewhere herein and in the referenced patents and applications. Biological activities of an ACoAS include binding to a substrate, and preferably for the present invention, a free fatty acid (FFA) of a PUFA, and catalyzing the conversion of the FFA to an acyl-CoA PUFA.

Modifications of a protein, such as in a homologue, may result in proteins having the same biological activity as the naturally occurring protein, or in proteins having decreased or increased biological activity as compared to the naturally occurring protein. Modifications which result in a decrease in protein expression or a decrease in the activity of the protein, can be referred to as inactivation (complete or partial), down-regulation, or decreased action (or activity) of a protein. Similarly, modifications which result in an increase in protein expression or an increase in the activity of the protein, can be referred to as amplification, overproduction, activation, enhancement, up-regulation or increased action (or activity) of a protein. It is noted that general reference to a homologue having the biological activity of the wild-type protein does not necessarily mean that the homologue has identical biological activity as the wild-type protein, particularly with regard to the level of biological activity. Rather, a homologue can perform the same biological activity as the wild-type protein, but at a reduced or increased level of activity as compared to the wild-type protein. A functional domain of a protein is a domain (i.e., a domain can be a portion of a protein) that is capable of performing a biological function (i.e., has biological activity).

Methods of detecting a protein or measuring the activity of a protein include, but are not limited to, measurement of transcription of the protein, measurement of translation of the protein, measurement of posttranslational modification of the protein, measurement of enzymatic activity of the protein, and/or measurement of production of one or more products resulting from the activity of the protein (e.g., PUFA production). It is noted that an isolated protein of the present invention (including a homologue) is not necessarily required to have the biological activity of the wild-type protein. For example, a protein can be a truncated, mutated or inactive protein, for example. Such proteins are useful in screening assays, for example, or for other purposes such as antibody production. In a preferred embodiment, the isolated proteins of the present invention have a biological activity that is similar to that of the wild-type protein (although not necessarily equivalent, as discussed above).

Methods to measure protein expression levels generally include, but are not limited to: Western blot, immunoblot, enzyme-linked immunosorbant assay (ELISA), radioimmunoassay (RIA), immunoprecipitation, surface plasmon resonance, chemiluminescence, fluorescent polarization, phosphorescence, immunohistochemical analysis, matrix-assisted laser desorption/ionization time-of-flight (MALDI-TOF) mass spectrometry, microcytometry, microarray, microscopy, fluorescence activated cell sorting (FACS), and flow cytometry, as well as assays based on a property of the protein including but not limited to enzymatic activity or interaction with other protein partners. Binding assays are also well known in the art. For example, a BIAcore machine can be used to determine the binding constant of a complex between two proteins. The dissociation constant for the complex can be determined by monitoring changes in the refractive index with respect to time as buffer is passed over the chip (O'Shannessy et al. *Anal. Biochem.* 212:457 (1993); Schuster et al., *Nature* 365:343 (1993)). Other suitable assays for measuring the binding of one protein to another include, for example, immunoassays such as enzyme linked immunoabsorbent assays (ELISA) and radioimmunoassays (RIA); or determination of binding by monitoring the change in the spectroscopic or optical properties of the proteins through fluorescence, UV absorption, circular dichroism, or nuclear magnetic resonance (NMR).

In one aspect of the invention, a protein encompassed by the present invention, including a homologue of a particular protein described herein, comprises an amino acid sequence that includes at least about 100 consecutive amino acids of the amino acid sequence from the reference protein, wherein the amino acid sequence of the homologue has a biological activity of the protein as described herein. In a further aspect, the amino acid sequence of the protein is comprises at least about 200 consecutive amino acids, and more preferably at least about 300 consecutive amino acids, and more preferably at least about 400 consecutive amino acids, and can include 500 consecutive amino acids, or more of the amino acid sequence of the reference protein, up to the full-length of the protein, including any increment that is a whole number integer (e.g., 200, 201, 202, 203, etc.).

According to the present invention, the term "contiguous" or "consecutive", with regard to nucleic acid or amino acid sequences described herein, means to be connected in an unbroken sequence. For example, for a first sequence to comprise 30 contiguous (or consecutive) amino acids of a second sequence, means that the first sequence includes an unbroken sequence of 30 amino acid residues that is 100% identical to an unbroken sequence of 30 amino acid residues in the second sequence. Similarly, for a first sequence to have "100% identity" with a second sequence means that the first sequence exactly matches the second sequence with no gaps between nucleotides or amino acids.

Typically, a homologue of a reference protein, such as any of the ACoAS proteins described herein, has an amino acid sequence that is at least about 50% identical, and more preferably at least about 55% identical, and more preferably at least about 60% identical, and more preferably at least about 65% identical, and more preferably at least about 70% identical, and more preferably at least about 75% identical, and more preferably at least about 80% identical, and more preferably at least about 85% identical, and more preferably at least about 90% identical, and more preferably at least about 95% identical, and more preferably at least about 96% identical, and more preferably at least about 97% identical, and more preferably at least about 98% identical, and more preferably at least about 99% identical (or any percentage between 60% and 99%, in whole single percentage increments) to the amino acid sequence of the reference protein (e.g., to an ACoAS protein). The homologue preferably has a biological activity of the protein or domain from which it is derived or related (i.e., the protein or domain having the reference amino acid sequence). With regard to ACoAS homologues, the homologue preferably has ACoAS enzymatic activity, and more specifically, the ability to catalyze the conversion of long chain PUFA free fatty acids (FFA) to acyl-CoA. With regard to other accessory proteins described herein, such proteins can have the biological activity of, for example, utilizing PUFA-CoA as substrates in forming PL or TAG.

As used herein, unless otherwise specified, reference to a percent (%) identity refers to an evaluation of homology which is performed using: (1) a BLAST 2.0 Basic BLAST homology search using blastp for amino acid searches, blastn for nucleic acid searches, and blastX for nucleic acid searches and searches of translated amino acids in all 6 open reading frames, all with standard default parameters, wherein the query sequence is filtered for low complexity regions by default (described in Altschul, S. F., Madden, T. L., Schääffer, A. A., Zhang, J., Zhang, Z., Miller, W. & Lipman, D. J. (1997) "Gapped BLAST and PSI-BLAST: a new generation of protein database search programs." Nucleic Acids Res. 25:3389, incorporated herein by reference in its entirety); (2) a BLAST 2 alignment (using the parameters described below); (3) and/or PSI-BLAST with the standard default parameters (Position-Specific Iterated BLAST). It is noted that due to some differences in the standard parameters between BLAST 2.0 Basic BLAST and BLAST 2, two specific sequences might be recognized as having significant homology using the BLAST 2 program, whereas a search performed in BLAST 2.0 Basic BLAST using one of the sequences as the query sequence may not identify the second sequence in the top matches. In addition, PSI-BLAST provides an automated, easy-to-use version of a "profile" search, which is a sensitive way to look for sequence homologues. The program first performs a gapped BLAST database search. The PSI-BLAST program uses the information from any significant alignments returned to construct a position-specific score matrix, which replaces the query sequence for the next round of database searching. Therefore, it is to be understood that percent identity can be determined by using any one of these programs.

Two specific sequences can be aligned to one another using BLAST 2 sequence as described in Tatusova and Madden, "Blast 2 sequences—a new tool for comparing protein and nucleotide sequences", *FEMS Microbiol Lett.* 174:247 (1999), incorporated herein by reference in its entirety. BLAST 2 sequence alignment is performed in blastp or blastn using the BLAST 2.0 algorithm to perform a Gapped BLAST search (BLAST 2.0) between the two sequences allowing for the introduction of gaps (deletions and insertions) in the resulting alignment. For purposes of clarity herein, a BLAST 2 sequence alignment is performed using the standard default parameters as follows.

For blastn, using 0 BLOSUM62 matrix:
   Reward for match=1
   Penalty for mismatch=−2
   Open gap (5) and extension gap (2) penalties
   gap x_dropoff (50) expect (10) word size (11) filter (on)
For blastp, using 0 BLOSUM62 matrix:
   Open gap (11) and extension gap (1) penalties
   gap x_dropoff (50) expect (10) word size (3) filter (on).

In one embodiment of the present invention, an isolated protein or domain of the present invention comprises, consists essentially of, or consists of, any of the amino acid sequences described in any of U.S. Pat. No. 6,566,583; Metz et al., *Science* 293:290-293 (2001); U.S. Patent Application Publication No. 20020194641; U.S. Patent Application Publication No. 20040235127; U.S. Patent Application Publication No. 20050100995; and U.S. Provisional Application No. 60/689,167, filed Jun. 10, 2005, or any biologically active fragments or domains thereof. These proteins are proteins of the PUFA PKS system and can be used in connection with any of the accessory proteins described herein.

In another embodiment of the invention, an amino acid sequence having the biological activity of a protein described herein (e.g., an ACoAS protein) includes an amino acid sequence that is sufficiently similar to the naturally occurring protein or polypeptide that is specifically described herein that a nucleic acid sequence encoding the amino acid sequence is capable of hybridizing under moderate, high, or very high stringency conditions (described below) to (i.e., with) a nucleic acid molecule encoding the naturally occurring protein or polypeptide (i.e., to the complement of the nucleic acid strand encoding the naturally occurring protein or polypeptide). Preferably, an amino acid sequence having the biological activity of a protein described herein is encoded by a nucleic acid sequence that hybridizes under moderate, high or very high stringency conditions to the complement of a nucleic acid sequence that encodes any of the amino acid sequences described herein. Methods to deduce a complementary sequence are known to those skilled in the art. It should be noted that since amino acid sequencing and nucleic acid sequencing technologies are not entirely error-free, the sequences presented herein, at best, represent apparent sequences of the proteins encompassed by the present invention.

As used herein, hybridization conditions refer to standard hybridization conditions under which nucleic acid molecules are used to identify similar nucleic acid molecules. Such standard conditions are disclosed, for example, in Sambrook et al., *Molecular Cloning: A Laboratory Manual*, Cold Spring Harbor Labs Press (1989). Sambrook et al., ibid., is incorporated by reference herein in its entirety (see specifically, pages 9.31-9.62). In addition, formulae to calculate the appropriate hybridization and wash conditions to achieve hybridization permitting varying degrees of mismatch of nucleotides are disclosed, for example, in Meinkoth et al., *Anal. Biochem.* 138, 267 (1984); Meinkoth et al., ibid., is incorporated by reference herein in its entirety.

More particularly, moderate stringency hybridization and washing conditions, as referred to herein, refer to conditions which permit isolation of nucleic acid molecules having at least about 70% nucleic acid sequence identity with the nucleic acid molecule being used to probe in the hybridization reaction (i.e., conditions permitting about 30% or less mismatch of nucleotides). High stringency hybridization and washing conditions, as referred to herein, refer to conditions which permit isolation of nucleic acid molecules having at least about 80% nucleic acid sequence identity with the nucleic acid molecule being used to probe in the hybridization reaction (i.e., conditions permitting about 20% or less mismatch of nucleotides). Very high stringency hybridization and washing conditions, as referred to herein, refer to conditions which permit isolation of nucleic acid molecules having at least about 90% nucleic acid sequence identity with the nucleic acid molecule being used to probe in the hybridization reaction (i.e., conditions permitting about 10% or less mismatch of nucleotides). As discussed above, one of skill in the art can use the formulae in Meinkoth et al., ibid. to calculate the appropriate hybridization and wash conditions to achieve these particular levels of nucleotide mismatch. Such conditions will vary, depending on whether DNA:RNA or DNA:DNA hybrids are being formed. Calculated melting temperatures for DNA:DNA hybrids are 10° C. less than for DNA:RNA hybrids. In particular embodiments, stringent hybridization conditions for DNA:DNA hybrids include hybridization at an ionic strength of 6×SSC (0.9 M Na$^+$) at a temperature of between about 20° C. and about 35° C. (lower stringency), more preferably, between about 28° C. and about 40° C. (more stringent), and even more preferably, between about 35° C. and about 45° C. (even more stringent), with appropriate wash conditions. In particular embodiments, stringent hybridization conditions for DNA:RNA hybrids include hybridization at an ionic strength of 6×SSC (0.9 M Na$^+$) at a temperature of between about 30° C. and about 45° C., more preferably, between about 38° C. and about 50° C., and even more preferably, between about 45° C. and about 55° C., with similarly stringent wash conditions. These values are based on calculations of a melting temperature for molecules larger than about 100 nucleotides, 0% formamide and a G+C content of about 40%. Alternatively, $T_m$ can be calculated empirically as set forth in Sambrook et al., supra, pages 9.31 to 9.62. In general, the wash conditions should be as stringent as possible, and should be appropriate for the chosen hybridization conditions. For example, hybridization conditions can include a combination of salt and temperature conditions that are approximately 20-25° C. below the calculated $T_m$ of a particular hybrid, and wash conditions typically include a combination of salt and temperature conditions that are approximately 12-20° C. below the calculated $T_m$ of the particular hybrid. One example of hybridization conditions suitable for use with DNA:DNA hybrids includes a 2-24 hour hybridization in 6×SSC (50% formamide) at about 42° C., followed by washing steps that include one or more washes at room temperature in about 2×SSC, followed by additional washes at higher temperatures and lower ionic strength (e.g., at least one wash as about 37° C. in about 0.1×-0.5×SSC, followed by at least one wash at about 68° C. in about 0.1×-0.5×SSC).

The present invention also includes a fusion protein that includes any protein or any homologue or fragment thereof of the present invention attached to one or more fusion segments. Suitable fusion segments for use with the present invention include, but are not limited to, segments that can: enhance a protein's stability; provide other desirable biological activity; and/or assist with the purification of the protein (e.g., by affinity chromatography). A suitable fusion segment can be a domain of any size that has the desired function (e.g., imparts increased stability, solubility, biological activity; and/or simplifies purification of a protein). Fusion segments can be joined to amino and/or carboxyl termini of the protein and can be susceptible to cleavage in order to enable straightforward recovery of the desired protein. Fusion proteins are preferably produced by culturing a recombinant cell transfected with a fusion nucleic acid molecule that encodes a protein including the fusion segment attached to either the carboxyl and/or amino terminal end of the protein of the invention as discussed above.

In one embodiment of the present invention, any of the amino acid sequences described herein, as well as homologues of such sequences, can be produced with from at least one, and up to about 20, additional heterologous amino acids flanking each of the C- and/or N-terminal end of the given amino acid sequence. The resulting protein or polypeptide can be referred to as "consisting essentially of" a given amino acid sequence. According to the present invention, the heterologous amino acids are a sequence of amino acids that are not naturally found (i.e., not found in nature, in vivo) flanking the given amino acid sequence or which would not be encoded by the nucleotides that flank the naturally occurring nucleic acid sequence encoding the given amino acid sequence as it occurs in the gene, if such nucleotides in the naturally occurring sequence were translated using standard codon usage for the organism from which the given amino acid sequence is derived. Similarly, the phrase "consisting essentially of", when used with reference to a nucleic acid sequence herein, refers to a nucleic acid sequence encoding a given amino acid sequence that can be flanked by from at least one, and up to as many as about 60, additional heterologous nucleotides at each of the 5' and/or the 3' end of the nucleic acid sequence encoding the given amino acid sequence. The heterologous nucleotides are not naturally found (i.e., not found in nature, in vivo) flanking the nucleic acid sequence encoding the given amino acid sequence as it occurs in the natural gene.

The minimum size of a protein or domain and/or a homologue or fragment thereof of the present invention is, in one aspect, a size sufficient to have the requisite biological activity, or sufficient to serve as an antigen for the generation of an antibody or as a target in an in vitro assay. In one embodiment, a protein of the present invention is at least about 8 amino acids in length (e.g., suitable for an antibody epitope or as a detectable peptide in an assay), or at least about 25 amino acids in length, or at least about 50 amino acids in length, or at least about 100 amino acids in length, or at least about 150 amino acids in length, or at least about 200 amino acids in length, or at least about 250 amino acids in length, or at least about 300 amino acids in length, or at least about 350 amino acids in length, or at least about 400 amino acids in length, or at least about 450 amino acids in length, or at least about 500 amino acids in length, and so on, in any length between 8 amino acids and up to the full length of a protein or domain of the invention or longer, in whole integers (e.g., 8, 9, 10, . . . 25, 26, . . . 500, 501, . . . ). There is no limit, other than a practical limit, on the maximum size of such a protein in that the protein can include a portion of the protein, domain, or biologically active or useful fragment thereof, or a full-length protein or domain, plus additional sequence (e.g., a fusion protein sequence), if desired.

Another embodiment of the present invention relates to isolated nucleic acid molecules comprising, consisting essentially of, or consisting of nucleic acid sequences that encode any of the proteins described herein, including a homologue or fragment of any of such proteins, as well as nucleic acid sequences that are fully complementary thereto. In accordance with the present invention, an isolated nucleic acid molecule is a nucleic acid molecule that has been removed from its natural milieu (i.e., that has been subject to human manipulation), its natural milieu being the genome or chromosome in which the nucleic acid molecule is found in nature. As such, "isolated" does not necessarily reflect the extent to which the nucleic acid molecule has been purified, but indicates that the molecule does not include an entire genome or an entire chromosome in which the nucleic acid molecule is found in nature. An isolated nucleic acid molecule can include a gene. An isolated nucleic acid molecule that includes a gene is not a fragment of a chromosome that includes such gene, but rather includes the coding region and regulatory regions associated with the gene, but no additional genes that are naturally found on the same chromosome, with the exception of other genes that encode other proteins of the PUFA PKS system as described herein, when the nucleic acid molecule encodes a core PUFA PKS protein. An isolated nucleic acid molecule can also include a specified nucleic acid sequence flanked by (i.e., at the 5' and/or the 3' end of the sequence) additional nucleic acids that do not normally flank the specified nucleic acid sequence in nature (i.e., heterologous sequences). Isolated nucleic acid molecule can include DNA, RNA (e.g., mRNA), or derivatives of either DNA or RNA (e.g., cDNA). Although the phrase "nucleic acid molecule" primarily refers to the physical nucleic acid molecule and the phrase "nucleic acid sequence" primarily refers to the sequence of nucleotides on the nucleic acid molecule, the two phrases can be used interchangeably, especially with respect to a nucleic acid molecule, or a nucleic acid sequence, being capable of encoding a protein or a domain of a protein.

Preferably, an isolated nucleic acid molecule of the present invention is produced using recombinant DNA technology (e.g., polymerase chain reaction (PCR) amplification, cloning) or chemical synthesis. Isolated nucleic acid molecules include natural nucleic acid molecules and homologues thereof, including, but not limited to, natural allelic variants and modified nucleic acid molecules in which nucleotides have been inserted, deleted, substituted, and/or inverted in such a manner that such modifications provide the desired effect (e.g., retain, improve or decrease activity of the protein). Protein homologues (e.g., proteins encoded by nucleic acid homologues) have been discussed in detail above.

A nucleic acid molecule homologue can be produced using a number of methods known to those skilled in the art (see, for example, Sambrook et al., *Molecular Cloning: A Laboratory Manual*, Cold Spring Harbor Labs Press (1989)). For example, nucleic acid molecules can be modified using a variety of techniques including, but not limited to, classic mutagenesis techniques and recombinant DNA techniques, such as site-directed mutagenesis, chemical treatment of a nucleic acid molecule to induce mutations, restriction enzyme cleavage of a nucleic acid fragment, ligation of nucleic acid fragments, PCR amplification and/or mutagenesis of selected regions of a nucleic acid sequence, synthesis of oligonucleotide mixtures and ligation of mixture groups to "build" a mixture of nucleic acid molecules and combinations thereof. Nucleic acid molecule homologues can be selected from a mixture of modified nucleic acids by screening for the function of the protein encoded by the nucleic acid and/or by hybridization with a wild-type gene.

The minimum size of a nucleic acid molecule of the present invention is a size sufficient to form a probe or oligonucleotide primer that is capable of forming a stable hybrid (e.g., under moderate, high or very high stringency conditions) with the complementary sequence of a nucleic acid molecule of the present invention, or of a size sufficient to encode an amino acid sequence having a biological activity of a protein according to the present invention. As such, the size of the nucleic acid molecule encoding such a protein can be dependent on the nucleic acid composition and percent homology or identity between the nucleic acid molecule and complementary sequence as well as upon hybridization conditions per se (e.g., temperature, salt concentration, and formamide concentration). The minimal size of a nucleic acid molecule that is used as an oligonucleotide primer or as a probe is typically at least about 12 to about 15 nucleotides in length if the nucleic acid molecules are GC-rich and at least about 15 to about 18 bases in length if they are AT-rich. There is no limit, other than a practical limit, on the maximal size of a nucleic acid molecule of the present invention, in that the nucleic acid molecule can include a sequence sufficient to encode a biologically active fragment of a protein or the full-length protein.

Another embodiment of the present invention includes a recombinant nucleic acid molecule comprising a recombinant vector and a nucleic acid sequence encoding a protein or peptide having a biological activity of any of the proteins described herein. Such nucleic acid sequences are described in detail above. According to the present invention, a recombinant vector is an engineered (i.e., artificially produced) nucleic acid molecule that is used as a tool for manipulating a nucleic acid sequence of choice and for introducing such a nucleic acid sequence into a host cell. The recombinant vector is therefore suitable for use in cloning, sequencing, and/or otherwise manipulating the nucleic acid sequence of choice, such as by expressing and/or delivering the nucleic acid sequence of choice into a host cell to form a recombinant cell. Such a vector typically contains heterologous nucleic acid sequences, that is nucleic acid sequences that are not naturally found adjacent to nucleic acid sequence to be cloned or delivered, although the vector can also contain regulatory nucleic acid sequences (e.g., promoters, untranslated regions) which are naturally found adjacent to nucleic acid molecules of the present invention or which are useful for expression of the nucleic acid molecules of the present invention (discussed in detail below). The vector can be either RNA or DNA, either prokaryotic or eukaryotic, and typically is a plasmid. The vector can be maintained as an extrachromosomal element (e.g., a plasmid) or it can be integrated into the chromosome of a recombinant organism (e.g., a microbe or a plant). The entire vector can remain in place within a host cell, or under certain conditions, the plasmid DNA can be deleted, leaving behind the nucleic acid molecule of the present invention. The integrated nucleic acid molecule can be under chromosomal promoter control, under native or plasmid promoter control, or under a combination of several promoter controls. Single or multiple copies of the nucleic acid molecule can be integrated into the chromosome. A recombinant vector of the present invention can contain at least one selectable marker.

In one embodiment, a recombinant vector used in a recombinant nucleic acid molecule of the present invention is an expression vector. As used herein, the phrase "expression vector" is used to refer to a vector that is suitable for production of an encoded product (e.g., a protein of interest). In this embodiment, a nucleic acid sequence encoding the product to be produced (e.g., a PUFA PKS domain or protein) is inserted into the recombinant vector to produce a recombinant nucleic acid molecule. The nucleic acid sequence encoding the protein to be produced is inserted into the vector in a manner that operatively links the nucleic acid sequence to regulatory sequences in the vector that enable the transcription and translation of the nucleic acid sequence within the recombinant host cell.

In another embodiment, a recombinant vector used in a recombinant nucleic acid molecule of the present invention is a targeting vector. As used herein, the phrase "targeting vector" is used to refer to a vector that is used to deliver a particular nucleic acid molecule into a recombinant host cell, wherein the nucleic acid molecule is used to delete, inactivate, or replace an endogenous gene or portion of a gene within the host cell or microorganism (i.e., used for targeted gene disruption or knock-out technology). Such a vector may also be known in the art as a "knock-out" vector. In one aspect of this embodiment, a portion of the vector, but more typically, the nucleic acid molecule inserted into the vector (i.e., the insert), has a nucleic acid sequence that is homologous to a nucleic acid sequence of a target gene in the host cell (i.e., a gene which is targeted to be deleted or inactivated). The nucleic acid sequence of the vector insert is designed to associate with the target gene such that the target gene and the insert may undergo homologous recombination, whereby the endogenous target gene is deleted, inactivated, attenuated (i.e., by at least a portion of the endogenous target gene being mutated or deleted), or replaced. The use of this type of recombinant vector to replace an endogenous *Schizochytrium* gene, for example, with a recombinant gene has been previously described by the present inventors, and the general technique for genetic transformation of Thraustochytrids is described in detail in U.S. patent application Ser. No. 10/124,807, published as U.S. Patent Application Publication No. 20030166207, published Sep. 4, 2003. Genetic transformation techniques for plants are well-known in the art.

Typically, a recombinant nucleic acid molecule includes at least one nucleic acid molecule of the present invention operatively linked to one or more expression control sequences. As used herein, the phrase "recombinant molecule" or "recombinant nucleic acid molecule" primarily refers to a nucleic acid molecule or nucleic acid sequence operatively linked to a expression control sequence, but can be used interchangeably with the phrase "nucleic acid molecule", when such nucleic acid molecule is a recombinant molecule as discussed herein. According to the present invention, the phrase "operatively linked" refers to linking a nucleic acid molecule to an expression control sequence (e.g., a transcription control sequence and/or a translation control sequence) in a manner such that the molecule can be expressed when transfected (i.e., transformed, transduced, transfected, conjugated or conduced) into a host cell. Transcription control sequences are sequences that control the initiation, elongation, or termination of transcription. Particularly important transcription control sequences are those that control transcription initiation, such as promoter, enhancer, operator and repressor sequences. Suitable transcription control sequences include any transcription control sequence that can function in a host cell or organism into which the recombinant nucleic acid molecule is to be introduced.

Recombinant nucleic acid molecules of the present invention can also contain additional regulatory sequences, such as translation regulatory sequences, origins of replication, and other regulatory sequences that are compatible with the recombinant cell. In one embodiment, a recombinant molecule of the present invention, including those that are integrated into the host cell chromosome, also contains secretory signals (i.e., signal segment nucleic acid sequences) to enable an expressed protein to be secreted from the cell that produces the protein. Suitable signal segments include a signal segment that is naturally associated with the protein to be expressed or any heterologous signal segment capable of directing the secretion of the protein according to the present invention. In another embodiment, a recombinant molecule of the present invention comprises a leader sequence to enable an expressed protein to be delivered to and inserted into the membrane of a host cell. Suitable leader sequences include a leader sequence that is naturally associated with the protein, or any heterologous leader sequence capable of directing the delivery and insertion of the protein to the membrane of a cell.

One or more recombinant molecules of the present invention can be used to produce an encoded product (e.g., an ACoAS) of the present invention. In one embodiment, an encoded product is produced by expressing a nucleic acid molecule as described herein under conditions effective to produce the protein. A preferred method to produce an encoded protein is by transfecting a host cell with one or more recombinant molecules to form a recombinant cell. Suitable host cells to transfect include, but are not limited to, any bacterial, fungal (e.g., yeast), protist, microalgae, algae, insect, plant or animal cell that can be transfected. In one embodiment of the invention, a preferred host cell is a plant host cell. Host cells can be either untransfected cells or cells that are already transfected with at least one other recombinant nucleic acid molecule.

According to the present invention, the term "transfection" is used to refer to any method by which an exogenous nucleic acid molecule (i.e., a recombinant nucleic acid molecule) can be inserted into a cell. The term "transformation" can be used interchangeably with the term "transfection" when such term is used to refer to the introduction of nucleic acid molecules into microbial cells, such as algae, bacteria and yeast, or into plant cells. In microbial and plant systems, the term "transformation" is used to describe an inherited change due to the acquisition of exogenous nucleic acids by the microorganism or plant and is essentially synonymous with the term "transfection." However, in animal cells, transformation has acquired a second meaning which can refer to changes in the growth properties of cells in culture after they become cancerous, for example. Therefore, to avoid confusion, the term "transfection" is preferably used with regard to the introduction of exogenous nucleic acids into animal cells, and the term "transfection" will be used herein to generally encompass transfection of animal cells, and transformation of microbial cells or plant cells, to the extent that the terms pertain to the introduction of exogenous nucleic acids into a cell. Therefore, transfection techniques include, but are not limited to, transformation, particle bombardment, diffusion, active transport, bath sonication, electroporation, microinjection, lipofection, adsorption, infection and protoplast fusion.

It will be appreciated by one skilled in the art that use of recombinant DNA technologies can improve control of expression of transfected nucleic acid molecules by manipulating, for example, the number of copies of the nucleic acid molecules within the host cell, the efficiency with which those nucleic acid molecules are transcribed, the efficiency with which the resultant transcripts are translated, and the efficiency of post-translational modifications. Additionally, the promoter sequence might be genetically engineered to improve the level of expression as compared to the native promoter. Recombinant techniques useful for controlling the expression of nucleic acid molecules include, but are not limited to, integration of the nucleic acid molecules into one or more host cell chromosomes, addition of vector stability sequences to plasmids, substitutions or modifications of transcription control signals (e.g., promoters, operators, enhancers), substitutions or modifications of translational control signals (e.g., ribosome binding sites, Shine-Delgarno sequences), modification of nucleic acid molecules to correspond to the codon usage of the host cell, and deletion of sequences that destabilize transcripts.

Many genetic modifications useful for producing bioactive molecules will be apparent to those of skill in the art, given the present disclosure, and various other modifications have been discussed previously herein. The present invention contemplates any genetic modification related to a PUFA PKS system and/or accessory protein as described herein which results in the production of a desired bioactive molecule.

Bioactive molecules, according to the present invention, include any molecules (compounds, products, etc.) that have a biological activity, and that can be produced by a PUFA PKS system. Such bioactive molecules can include, but are not limited to: a polyunsaturated fatty acid (PUFA), an anti-inflammatory formulation, a chemotherapeutic agent, an active excipient, an osteoporosis drug, an anti-depressant, an anti-convulsant, an anti-*Heliobactor pylori* drug, a drug for treatment of neurodegenerative disease, a drug for treatment of degenerative liver disease, an antibiotic, and a cholesterol lowering formulation. One advantage of the PUFA PKS system of the present invention is the ability of such a system to introduce carbon-carbon double bonds in the cis configuration, and molecules including a double bond at every third carbon. This ability can be utilized to produce a variety of compounds.

Each publication, patent or patent application referenced herein is incorporated herein by reference in its entirety.

The following examples are provided for the purpose of illustration and are not intended to limit the scope of the present invention.

EXAMPLES

General Introduction to Examples. Genes encoding PUFA synthases have been identified in marine bacteria and in thraustochytrid species. Several of these gene sets have been expressed in *E. coli* and, when supplied with an appropriate PPTase, the particular PUFA products of those enzymes can accumulate in those cells. However, to the present inventors' knowledge, the method of release of the PUFAs from these enzymes has not previously been described. The release mechanism has implications related to expression of PUFA synthase systems in heterologous host organisms. It also can provide a direction to efforts aimed a modulating the flux of carbon through that system and the eventual amount of PUFAs that accumulate in heterologous, or native, host organisms. Here the present inventors show that the products of the *Schizochytrium* PUFA synthase (and, without being bound by theory, likely all eukaryotic PUFA synthase systems, including all thraustochytrid PUFA PKS systems) are free fatty acids, and that the release of the free fatty acid is integral to the enzyme complex itself. Further, in *Schizochytrium*, the PUFA FFA is esterified to CoA prior to entry into the phospholipids (PL) and triacylglycerols (TAG). The data described in the Examples below indicate strategies for expression in heterologous host organisms as well as for modification of PUFA accumulation in native host organisms.

Example 1

This example describes the creation of a *Schizochytrium* FAS knockout strain for biochemical studies.

*Schizochytrium* contains a single large gene that encodes the FAS enzyme responsible for production of short chain saturated fatty acids (described in U.S. Patent Application Publication No. 20050191679 A1). A *Schizochytrium* FAS knock out (FAS-KO) construct was made using procedures described in U.S. Pat. No. 7,001,772. An ~10.0 kB EcoRV fragment of genomic DNA containing most of the FAS Orf (from about 728 bp downstream of the presumed ATG start codon to about 680 bp downstream of the stop codon) was cloned into a Stratagene bluescript vector (pBSK) at the EcoRV site of the multiple cloning region. An ~3.5 kB internal BglII fragment was removed from the cloned *Schizochytrium* DNA and replaced with an ~1.1 kB BamHI fragment from pTubZeo11-2 containing a Zeocin resistance cassette (see U.S. Pat. No. 7,001,772, supra). The plasmid (pJK878) was introduced into a cell wall defective strain of *Schizochytrium* (denoted Ac66) via particle bombardment. Transformants were initially selected by plating on media containing Zeocin and supplemented with palmitic acid. A secondary selection, failure to grow on plates not supplemented with palmitic acid, was used to identify potential double crossover events in which a portion of the FAS genomic region had been replaced by the Zeocin resistant cassette. PCR and Southern blot analyses were used to confirm that one of the transformants (labeled FAS-KO) had the anticipated genomic structure. This strain was maintained by growing in media supplemented with 500 uM palmitic acid. A similar strategy, i.e. insertion of a Zeocin resistance cassette into one of the genes encoding a subunit of the *Schizochytrium* PUFA synthase, was employed to inactivate that enzyme in the *Schizochytrium* Ac66 strain. In this case the medium is supplemented with 500 uM DHA. Whole cells and cell free extracts of these strains were used in subsequent biochemical studies (see Examples below).

Example 2

The following example describes the general protocol for preparation of cell free extracts of *Schizochytrium* Ac66, and PUFA synthase KO and FAS-KO strains derived from *Schizochytrium* Ac66.

An example of a protocol for preparation of cell free homogenates (CFH) from the cell wall deficient strains of *Schizochytrium* is as follows. Cells were grown in A50-3 medium and then diluted into M2B medium. The media used for growing the KO strains were supplemented with the appropriate fatty acid. Cells were grown to an OD600 nm of >~2.5 and <~5 in the M2B media. Cells in 50 mL of culture medium were collected by centrifugation (table top centrifuge—~1200 rpm×4 minutes) in 50 mL plastic tubes. The supernatant was decanted and the cells resuspended 5 mL Buffer A (100 mM Phosphate pH 7.2, 10% (w/v) glycerol, 1 mM EDTA and 2 mM DTT) and centrifuged as before. The supernatant was discarded and the cells resuspended in ice cold 5 mL Buffer A. The suspension was sonicated (Ultrasonic Processor Model GE130 with microtip, Pulser at 2 seconds, ~1 Watt power setting) with tube on ice for 1.5 minutes. The sample was checked by microscopy to ensure that all of the cells were broken. The CFH was aliquoted in 200 uL portions into 0.5 mL PCR tubes with caps and frozen by dropping into liquid $N_2$. Samples were stored at −74° C. until needed.

Example 3

This example describes the general conditions for in vitro FAS and PUFA synthase activity assays.

An example of a protocol for in vitro activity assays of both FAS and PUFA synthase activities is as follows. In a final volume of 100 uL, mix the enzyme preparation and Buffer A (volume of these 2 components=90 uL) plus the following components added as a cocktail (in 10 uL) to yield the final concentrations indicated in parenthesis: malonyl-CoA (50 uM—a mixture of cold and malonyl-2-$^{14}$C-CoA such that the final concentration of radiolabel is 0.65 µCi/mL), NADH (1 mM), NADPH (1 mM) and acetyl-CoA (10 uM). These components and additional components can be adjusted depending on the requirements of the particular experiments. The assay reactions are carried out in glass tubes in a room temperature (~21° C.) water bath. The time of incubation is dependant on the experimental requirements. The reactions are stopped by one of two methods depending on the work-up protocol. For conversion of fatty acids to fatty acid methylesters (FAMEs) using an acidic method, the reaction is stopped by adding the FAME reagent (see below). For extraction of lipids without derivatization, the reaction is stopped by addition of 125 uL of isopropanol:acetic acid (4:1 v/v) (see below).

Acidic FAME Protocol: Stop the reaction by adding 2.0 mL of 4% HCl in methanol plus 50 uL toluene, seal the glass tubes with Teflon lined caps and heat at 100° C. for 1 hr. Cool to room temperature, add 1.0 mL of hexane and 0.5 mL water, vortex then let separate. If desired, remove a portion for liquid scintillation counting (LSC). Transfer ~600 uL of organic phase to a new tube and remove the solvent under $N_2$. Dissolve the residue in 50 uL hexane and spot onto either Silica gel 60 A TLC plates (develop with hexane:diethyl-ether:acetic acid—70:30:2) or Silica Gel G plates soaked in 10% $AgNO_3$/90% acetonitrile (activated for 30 min at 100° C. prior to use) (develop w/hexane:diethyl-ether/acetic acid—70:20:2). Let the plates air dry and detect radioactive areas using phosphorimaging technology.

HIP Protocol—Extraction of Underivatized Lipids: As indicated above, stop the reaction by adding of 125 uL of isopropanol:acetic acid (4:1 v/v) then add 2 mL of hexane:isopropanol (3:2, v/v), vortex then add 1 mL of 6.7% (w/v) sodium sulfate and vortex again. Let the phases separate. If desired, remove a portion of the organic (upper) phase for LSC then transfer the rest (~1.0 mL) to a new tube. Remove solvent with $N_2$ gas and dissolve the residue in 50 uL of hexane. Spot the sample on a silica gel 60 A TLC plate and develop with hexane:diethyl-ether:acetic acid (70:30:2). Let the plate air dry and detect radioactive areas using phosphorimaging technology.

Example 4

The following example describes the results of in vitro assays of FAS and PUFA synthase activities.

CFHs of Schizochytrium Ac66 and the PUFA synthase KO and FAS-KO strains derived from Schizochytrium Ac66 were prepared and assayed for FAS and PUFA synthase activities as described above using the acidic FAME and silver TLC protocols. FIG. 1 shows the results of those assays. Briefly, FIG. 1 shows a phosphorimage analysis of in vitro activity assays of cell free homogenates of Schizochytrium strain Ac66 and PUFA-S KO and FAS KO mutants derived from that strain. Assays were run for 30 minutes, FAMEs were prepared and extracted using the acidic protocol and separated by argentation TLC. The labeled bands on the image of the TLC plate represent radioactivity incorporated into FAMEs (verified by co-migration with standards as well as by HPLC separations). Lanes 1 and 2 show the profiles obtained using extracts from the Ac66 parental strain. Products of both the FAS (14:0 and 16:0 FAMEs) and the PUFA synthase (DHA and DPA n-6) can be observed in these lanes. The profiles obtained when the PUFA synthase enzyme has been inactivated are shown in lanes 3 and 4. In this case, the DHA and DPA n-6 FAMEs are not present. The profiles obtained when the FAS is inactivated are shown in Lanes 5 and 6. In this case, the fatty acids derived from the FAS, i.e. 14:0 and 16:0 and derivatives of those fatty acids are missing. The data indicate that the FAS activity has been severely, or completely, impaired in this FAS-KO strain. The FAS-KO strain was used for further characterization of the Schizochytrium PUFA synthesis and accumulation pathway.

Example 5

The following example describes additional characterization of PUFA synthesis in Schizochytrium and provides evidence that the initial product of the Schizochytrium PUFA synthase is a free fatty acid (FFA).

Figure 2:
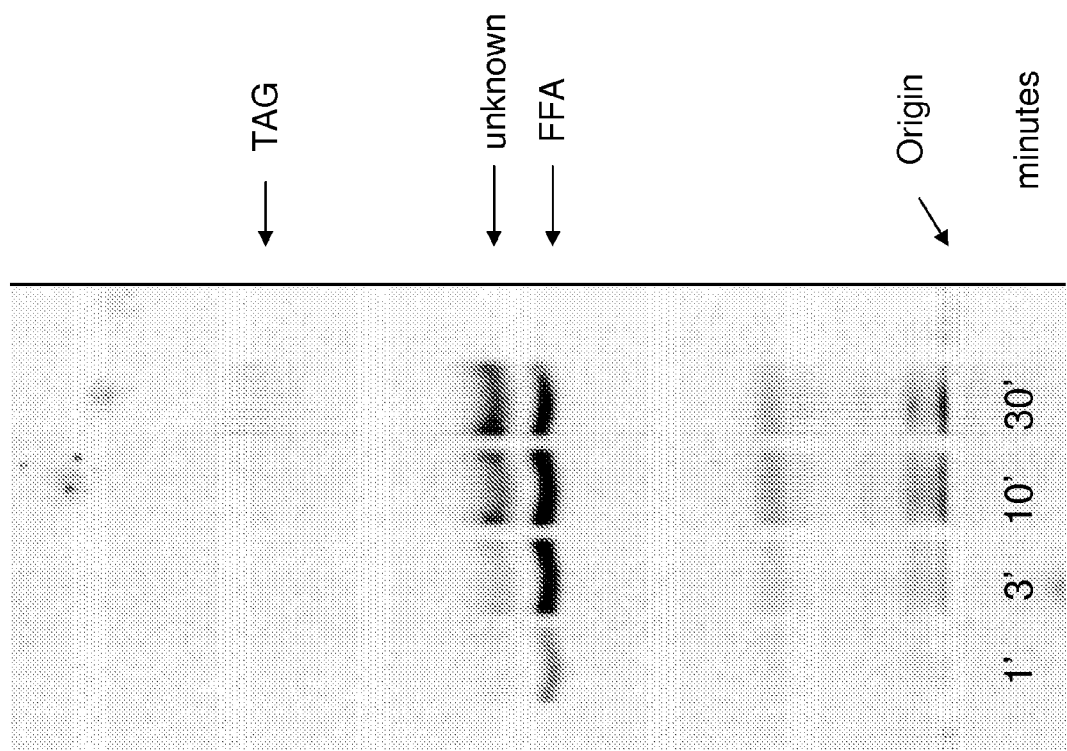
FIG. 2 is a digitized image showing the phosphorimage analysis of normal phase TLC separations of in vitro activity assays in the *Schizochytrium* FAS-KO strain. Reactions were run for the indicated times.
Figure 3:
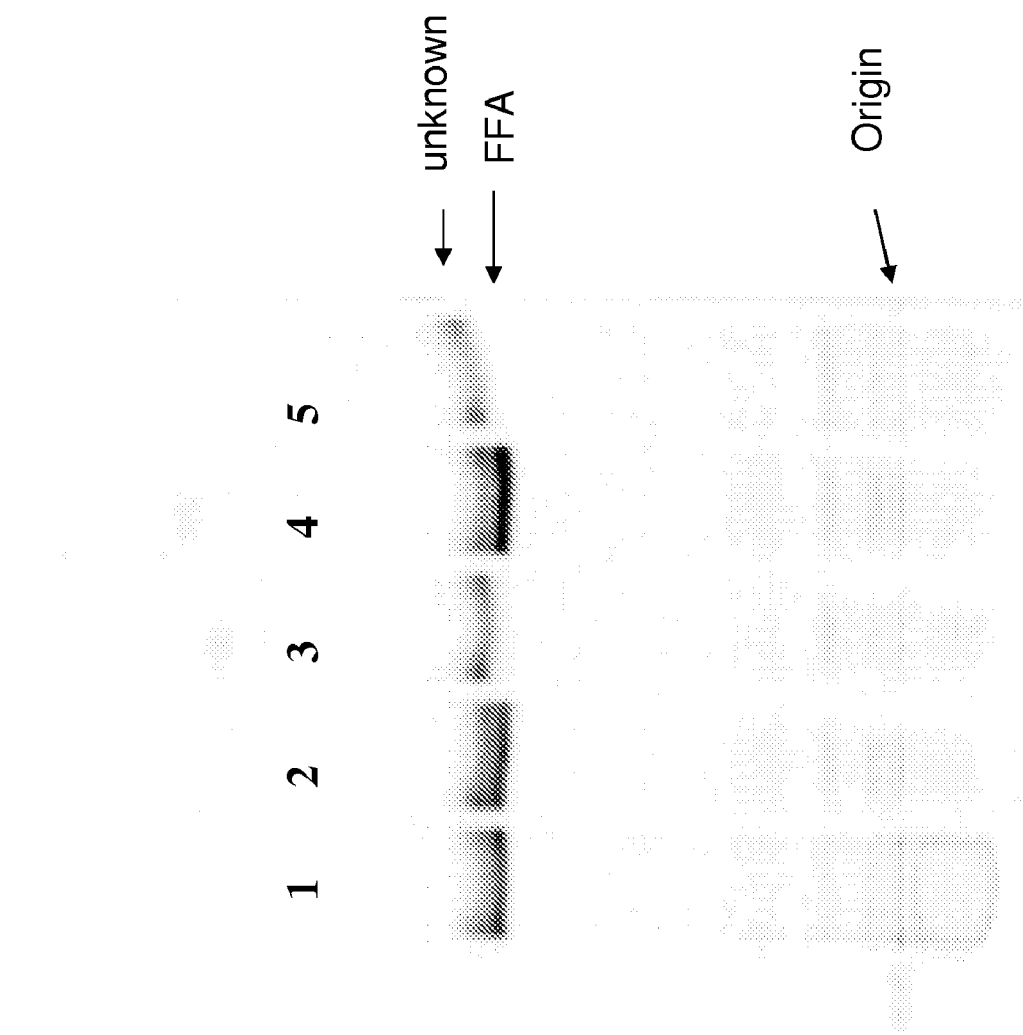
FIG. 3 is a digitized image showing the phosphorimage analysis of normal phase TLC separations of in vitro activity assays the *Schizochytrium* FAS-KO strain. Standard assay components were used but the NADH, NADPH and acetyl-CoA components were varied (Lane 1—NADH/NADPH/acetyl-CoA, Lane 2—NADPH/acetyl-CoA, Lane 3—NADH/acetyl-CoA, Lane 4—NADH/NADPH, Lane 5—none).

Conversion of in vitro assay reaction products to FAMEs using the acidic method is useful to determine incorporation of radioactivity from malonyl-CoA into fatty acid moieties but it does not show the molecular form of those fatty acids prior to that derivatization. FIG. 2 shows the results of a time course of an in vitro assay of the FAS-KO strain in which the lipids were extracted using the HIP protocol described above (i.e., without conversion of fatty acyl moieties to methyl esters) and then separated using normal phase TLC. Specifically, FIG. 2 shows a phosphorimage analysis of normal phase TLC separations of in vitro activity assays the FAS-KO strain. Reactions were run for the indicated times and the lipids extracted using the HIP protocol. The positions on the plate where TAG and free fatty acid (FFA) standards migrate are indicated to the left. In this TLC system, FFA of different chain lengths and degrees of unsaturation are not well separated. However, since the strain utilized has little or no FAS activity FFAs in this zone are likely to be derived from the PUFA synthase system. Additional evidence supporting this is shown in FIG. 3. FIG. 3 shows a phosphorimage analysis of normal phase TLC separations of in vitro activity assays the FAS-KO strain. Standard assay components were used but the NADH, NADPH and acetyl-CoA components were varied. Inclusion of these components as shown in FIG. 3 are as follows: Lane 1—NADH/NADPH/acetyl-CoA, 2—NADPH/acetyl-CoA, 3—NADH/acetyl-CoA, 4—NADH/NADPH, 5—none. Here it is shown that appearance of radiolabel in the FFA band during the in vitro assay is dependant on the addition of NADPH. In contrast, NADH does not support the reaction. This strict dependence on NADPH as a reductant is also a characteristic of the PUFA synthase derived from Shewanella SCRC2738 (FIG. 2C of Metz et al., Science 293:290-293 (2001)). In both FIGS. 2 and 3, a radiolabeled band migrating slightly faster than the FFA band is apparent (labeled as 'Unknown'). Since the appearance of the band is independent of addition of reductant (NADH or NADPH—see lane 5, FIG. 3), it is unlikely to be associated with the PUFA synthase activity. Additionally this band can be detected during a similar analysis of strains in which the PUFA synthase has been inactivated (data not shown). The data in FIGS. 2 and 3 suggest that the initial product of the Schizochytrium PUFA synthase is a FFA. In FAS systems that release their products as FFA (such as mammalian FAS), those FFA are then esterified to CoA prior to entry into PL or TAG. The activation of the FFA is carried out by acyl-CoA synthetases in a reaction that requires ATP and $Mg^{+2}$. The appearance of some radioactivity in a TAG fraction late in a time course of the in vitro reaction would be consistent with such a pathway in *Schizochytrium* (due to residual ATP in the sample). This concept was tested further (see below).

Example 6

The following example provides evidence in support of the involvement of acyl-CoA synthetase reaction in the PUFA accumulation pathway of *Schizochytrium*.

The effects of addition of ATP (2.5 mM) and $Mg^{+2}$ (10 mM) on the in vitro assay products in samples from the *Schizochytrium* FAS-KO are shown in FIG. 4. Briefly, FIG. 4 shows the results of a phosphorimage analysis of normal phase TLC separations of in vitro activity assays the FAS-KO strain. Reactions were run for 10 minutes then ATP and Mg+2 were added. The reactions were stopped at the times indicated at the bottom of FIG. 4 ("=sec, '=min) and the lipids extracted using the HIP protocol. The samples were incubated in the standard reaction mixture for 10 minutes and then ATP and $Mg^{+2}$ were added. The reactions were stopped at various time points after the addition of ATP and $Mg^{+2}$ (i.e., 0=no addition, 10 and 30 sec, and 1, 3, 10 and 30 min). It can be seen that radiolabel associated with the FFA band decreases and radiolabel associated with the TAG band increases during the time course. The radiolabel associated with the band labeled 'Unknown' is unaffected by the addition of ATP. These data are consistent with the involvement of an ATP requiring reaction for migration of labeled FFA into the TAG fraction.

Triacsin C has been characterized as a specific inhibitor of acyl-CoA synthetases that activate long chain PUFAs (Knoll et al., 1995). The effects of Triacsin C on the product profile during the in vitro assays of FAS-KO samples were tested. The sample was incubated in the standard cocktail containing various concentrations of Triacsin C (0, 25, 100 or 200 uM) for 10 minutes and then ATP and $Mg^{+2}$ were added. The reaction was allowed to proceed for an additional 20 minutes and then stopped and the lipids extracted and separated by TLC using the HIP protocol. The results are shown in FIG. 5. Briefly, FIG. 5 shows a phosphorimage analysis of normal phase TLC separations of in vitro activity assays the FAS-KO strain. Reactions were run for 10 minutes, ATP and Mg+2 were added (except in sample 1) and incubations continued for an additional 20 min. In addition the following samples contained: 3—2 uL DMSO, 4—4 uL DMSO, 5—25 uM Triascin C, 6—100 uM Triascin C, 7—200 uM Triascin C. Triascin C was added from a concentrated solution in DMSO. Reactions were stopped and the lipids extracted using the HIP protocol. The addition of the Triascin C at higher concentrations blocked the loss of radiolabel from the FFA band. These results are consistent with the involvement of an acyl-CoA synthetase in the pathway.

Example 7

The following example describes in vitro assays of extracts from *E. coli* expressing *Schizochytrium* Orf A, OrfBss (OrfB*), OrfC and *Nostoc* HetI.

The data shown in the Examples above indicate that the PUFAs in *Schizochytrium* are converted to the free fatty acid form prior to entry into TAG and PL. Data indicating that the release of the PUFA as a free fatty acid is an integral part of the PUFA synthase enzyme is presented here. *Schizochytrium* native Orf A (nucleic acid sequence represented by SEQ ID NO:1), OrfBss (also denoted OrfB*; nucleic acid sequence represented by SEQ ID NO:37) and native OrfC (nucleic acid sequence represented by SEQ ID NO:5) were cloned as an artificial operon in a pET vector and expressed in *E. coli* as described in U.S. Patent Application Publication No. 20050100995, supra. Het I was cloned into a pACYC based vector and expressed in those same cells. Cells were grown to an O.D. of ~1 and IPTG added (final concentration of 1 mM) to induce production of the T7 polymerase. Approximately 4 hours after induction, the cells were harvested, washed with Buffer A and ruptured by two passages through a French pressure cell. Aliquots of the homogenate were set aside, and the rest centrifuged (5 k×g×5 min) to yield Supernatant 1 (S1). Again, aliquots were set aside and the balance of the material centrifuged at 100,000×g for 1 hour to yield high speed pellet (P2) and high speed supernatant (S2) fractions. The pellet fraction was resuspended in Buffer A to the volume originally placed in the centrifuge tube. All of these fractions were assayed using the general methods described above using the acidic FAME/silver phase TLC workup or the HIP extraction of lipids followed by separation on normal phase TLC. FIG. 6 shows the results of those assays.

The acidic FAME analysis (FIG. 6A) shows that the primary products of the in vitro assay are DHA and DPA n-6. The fraction with the highest activity is the homogenate with much less activity in the S1 and P2 fractions. Very little activity was detected in the S2 fraction. It is of interest here that even in the CFH and S1 fractions, very little evidence of the products of the FAS system can be detected (indicated by the arrow labeled as 16:0 in FIG. 6A). This is likely due to the high levels of expression of the PUFA synthase enzyme components when using the T7 system. In contrast, when similar assays were performed on extracts (CFH and S1) from *E. coli* containing a cosmid encoding an EPA synthase from *Shewanella*, the majority of the radioactivity on the TLC plate was associated with FAS products (Metz et al., *Science* 293: 290-293 (2001), FIG. 2B). Also, the endogenous *E. coli* FAS system is composed of several individual soluble proteins and the FAS activity remains in the supernatant fraction after high-speed centrifugation (Metz et al., *Science* 293:290-293 (2001), FIG. 2B). In contrast, the PUFA synthase activity shown in FIG. 6A partitions into the pellet fraction after high-speed centrifugation.

The data in FIG. 6B show the results of assays of samples of the same *E. coli* strain used for FIG. 6A, except that in the lipid products were simply extracted with HIP (rather than being converted to FAMES) prior to separation by TLC. Two fractions were used, the CFH (left side of the figure) and the P2 (on the right side). Amounts of the extracts used in the assays were adjusted so that approximately equal amounts of radioactivity were incorporated into lipids in the two cases. Also shown are the results in which the reductant component (NADH and/or NADPH) of the assay cocktail was varied as follows: Lane 1—only NADPH, Lane 2—only NADPH, Lane 3—both NADH and NADPH, and Lane 4—water was added instead of the stock solutions containing either component. The data in FIG. 6B show that most of the radiolabel that moves on the TLC plate co-migrates with free fatty acid standards. Also, the appearance of the major (FFA) band is dependant on the addition of NADPH to the assay cocktail. The requirement for NADPH and the lack of significant FAS activity in these fractions (especially the P2 fraction) indicate that the FFA is the product of the PUFA synthase enzyme. Since only three genes from *Schizochytrium* (encoding Orfs A, B and C) were expressed in this strain of *E. coli* (along with Het I), the data indicate that release of the PUFA from the synthase is an inherent property of that enzyme and not due to a separate thioesterase enzyme.

A variety of data, important aspects of which have been presented in the Examples above, indicate the following features of PUFA synthesis and accumulation in *Schizochytrium*.

The PUFA synthase responsible for both DPAn-6 and DHA is encoded by Orfs A, B and C as described in U.S. Pat. No. 6,566,583, Metz et al., *Science* 293:290-293 (2001), U.S. Patent Application Publication No. 20020194641, and PCT Publication No. WO 2006/135866. The ACP domains of subunit A are activated by an endogenous PPTase. The synthesis reaction uses malonyl-CoA as carbon source (acetyl-CoA may or may not also be required) and NADPH as a reductant. The PUFA products are released from the enzyme as FFAs and this release is an inherent feature of the enzyme itself. The FFAs are esterified to CoA in an ATP dependent reaction catalyzed by one or more endogenous acyl-CoA synthetases. The PUFA-CoAs then serve as substrates for the PL and TAG synthesis enzymes.

Example 8

The following example shows the expression of genes encoding the *Schizochytrium* PUFA synthase (sOrfA, sOrfB and native OrfC, see below) along with Het I in baker's yeast.

The *Schizochytrium* PUFA synthase genes and Het I were expressed in yeast using materials obtained from Invitrogen. The INVsc1 strain of *Saccharomyces cerevisiae* was used along with the following transformation vectors: pYESLeu (sOrfA, SEQ ID NO:35, encoding SEQ ID NO:2), pYES3/CT (sOrfB, SEQ ID NO:36, encoding SEQ ID NO:4), pYES2/CT (OrfC, SEQ ID NO:5, encoding SEQ ID NO:6) and pYESHis (HetI, SEQ ID NO:33, encoding SEQ ID NO:34). Some of the vectors were modified to accommodate specific cloning requirements. Appropriate selection media were used, depending on the particular experiment. The genes were cloned, in each case, behind a GAL1 promoter and expression was induced by re-suspension of washed cells in media containing galactose according to guidelines provide by Invitrogen. Cells were grown at 30° C. and harvested (by centrifugation) at the indicated times after being transferred to the induction medium. The cell pellets were freeze dried and FAMEs were prepared using acidic methanol, extracted into hexane and analyzed by GC.

Preliminary experiments indicated that expression of the native form of OrfA (SEQ ID NO:1) and slightly modified native form of OrfB (OrfB*, SEQ ID NO:37) in yeast did not result in production of proteins of the expected size (correct mRNAs were also not detected). In contrast, a protein of the expected size was detected in cell in which the native form of OrfC (SEQ ID NO:5) was expressed. The genes encoding OrfsA and B were resynthesized so that their codon usage was more in line with those tolerated by yeast (resynthesis was performed by Blue Heron, Inc.). These synthetic genes are indicated herein as sOrfA (SEQ ID NO:35) and sOrfB (SEQ ID NO:36). Expression of these genes in yeast resulted in accumulation of proteins corresponding to the expected sizes of Orf A and B, respectively.

FIG. 7 shows a comparison of the fatty acid profile from yeast cells expressing the *Schizochytrium* PUFA synthase system (sOrfA, sOrfB, OrfC and Het I) and one obtained from control cells (lacking the sOrfA gene). Cells were collected ~20 hrs after induction. It can be seen that two novel FAME peaks have appeared it the profile of the strain expressing the complete PUFA synthase system. These two peaks were identified as DPA n-6 and DHA by comparison of the elution time with authentic standards and subsequently by MS analyses. As predicted from the inventors' characterization of the *Schizochytrium* PUFA synthase, aside from DHA and DPA n-6, no other novel peaks are evident in the profile.

FIG. 8 shows the region of the GC chromatogram of FIG. 7, which contains the PUFA FAMEs. Both the control cells and the cells expressing the PUFA synthase contain a peak that elutes near the DHA FAME. This has been identified as C26:0 FAME and (based on literature references) is derived from sphingolipids. Although it elutes close to the DHA peak, the resolution is sufficient so that it does not interfere with the quantitation of DHA. The DPAn-6 peak is well separated from other endogenous yeast lipids in the FAME profile. In this particular example, the cells expressing the *Schizochytrium* PUFA synthase system accumulated 2.4% DHA and 2.0% DPAn-6 (as a percentage of the total FAMEs). The sum of DHA and DPA n-6=4.4% of the measured fatty acids in the cells. The ratio of DHA to DPA n-6 observed in the cells was ~1.2:1.

The results presented above showing expression of the *Schizochytrium* PUFA synthase in yeast provide a confirmation of the pathway proposed in the previous applications as well as the predictions in terms of the alterations to the fatty acid profiles that can be expected in yeast and also in plants.

Example 9

The following example describes increasing the accumulation of PUFAs in yeast expressing the *Schizochytrium* PUFA synthase by co-expression of specific acyl-CoA synthetases.

The inventors have shown that in *Schizochytrium*, the FFA products of its PUFA synthase are efficiently converted to acyl-CoA by endogenous acyl-CoA synthetases (ACoASs) (see Examples above). By examination of an EST database, the inventors identified 9 putative ACoASs that may be involved in conversion of the PUFAs to the corresponding acyl-CoAs.

Briefly, the present inventors have examined a *Schizochytrium* EST database consisting of sequences obtained from ~20,000 plasmids isolated from colonies picked from various cDNA libraries for those ESTs that show homology to proteins with known (or suspected) ACoAS activities. The inventors used the Vector NTI program, Contig Express, to assemble these into contigs (when two or more overlapping sequences were available) and edited these based on the quality of the individual sequence information. The results of this effort are summarized below. Eight different contigs and one singlet (no overlapping sequences in the database) were identified that were candidates for being associated with ACoAS enzymes that can efficiently convert the product of the PUFA synthase into the corresponding acyl-CoA. Using the EST data set as a guide, the complete coding regions sequences for each candidate was obtained and verified using various standard methods (e.g., sequencing of subclones of genomic DNA and PCR products derived from genomic DNA).

*Schizochytrium* Acyl-CoA Synthetase (ACS) Coding Sequences and Deduced Translations:

1. Length=2004 nucleotides (not including the stop codon) (SEQ ID NO:82). It is predicted to encode a 668 amino acid (SEQ ID NO:83), 73.5 kDa, protein. The protein sequence has good homology to known ACSs. The best Blast match is to a *Thalassiosira pseudonanna* ACS (TplacA, Accession number: AAW58006) that has been characterized and shown to have high activity with DHA (Tonon et al., *Plant Physiol.* 2005 May; 138(1):402-8). The C-terminal three amino acids of SEQ ID NO:83 are: SKL—a motif associated with targeting of proteins to the peroxisome. This C-terminal motif is also present in the *Thalassiosira pseudonanna* ACS mentioned above.

2. ScACS-2 (also denoted ScACoAS-2 or ACS-2): Length=2340 (not including the stop codon) nucleotides (SEQ ID NO:84). It is predicted to encode a 780 amino acid (SEQ ID NO:85), 84.7 kDa, protein. There is good homology over most of the putative protein to known ACSs including the human examples, Lipidosin and Bubble Gum.

3. ScACS-3 (also denoted ScACoAS-3 or ACS-3): Length=2526 (not including the stop codon) nucleotides (SEQ ID NO:86). It is predicted to encode an 842 amino acid (SEQ ID NO:87), 90.6 kDa, protein. There is good homology over most of the putative protein (particularly, the central ~700 amino acids) with Bubble Gum type ACS proteins.

4. ScACS-4 (also denoted ScACoAS-4 or ACS-4): Length=2037 (not including the stop codon) nucleotides (SEQ ID NO:88). It is predicted to encode a 679 amino acid (SEQ ID NO:89), 74.7 kDa protein. There is good homology over most of the protein with known ACS proteins, including examples from humans and other mammals.

5. ScACS-5 (also denoted ScACoAS-5 or ACS-5): Length=1734 nucleotides (not including the stop codon) (SEQ ID NO:90). It is predicted to encode a 578 amino acid (SEQ ID NO:91), 63.1 kDa, protein. There is good homology over most of the protein with known ACS proteins. The best Blast matches are to bacterial ACSs. The C-terminal three amino acids of SEQ ID NO:91 are: SKL—a motif associated with targeting of proteins to the peroxisome.

6. ScACS-6 (also denoted ScACoAS-6 or ACS-6): Length=1806 (not including the stop codon) nucleotides (SEQ ID NO:92). It is predicted to encode a 602 amino acid (SEQ ID NO:93), 66.0 kDa protein. There is good homology over most of the protein with known ACS proteins. The best Blast matches are to bacterial ACSs. The C-terminal three amino acids of SEQ ID NO:93 are: SKL—a motif associated with targeting of proteins to the peroxisome.

7. ScACS-7 (also denoted ScACoAS-7 or ACS-7): Length=1920 (not including the stop codon) nucleotides (SEQ ID NO:94). It is predicted to encode a 640 amino acid protein (SEQ ID NO:95), 70.4 kDa. There is good homology over most of the protein with known ACS proteins. The best Blast matches are to bacterial ACSs.

8. ScACS-8 (also denoted ScACoAS-8 or ACS-8): Length=1893 (not including the stop codon) nucleotides (SEQ ID NO:96). It is predicted to encode a 631 amino acid (SEQ ID NO:97), 70.7 kDa protein. The best Blast matches are to members of a fatty acid transporter protein family that may also have ACoAS activity.

9. ScACS-9 (also denoted ScACoAS-9 or ACS-9): Length=2950 (not including the stop codon) nucleotides (SEQ ID NO:98). It is predicted to encode a 766 amino acid (SEQ ID NO:99), 84.1 kDa protein. There is good homology over most of the protein with known ACS proteins. The best Blast matches are to animal ACSs.

The inventors believed that enzymes present in heterologous hosts of the PUFA synthases may not be able to efficiently process the novel (for that organism) PUFA free fatty acids (FFAs), and that co-expression of appropriate ACoAS(s) would result in increased accumulation of the PUFAs in that host. Two of the Schizochytrium candidate ACoASs described above (ScACS-1, SEQ ID NO:82/83 and ScACS-2, SEQ ID NO:84/85) were individually expressed in yeast that contained the genes encoding the Schizochytrium PUFA synthase system (e.g., sOrfA, sOrfB and nOrfC, and HetI).

More specifically, the yeast expression system described in the Examples above was modified to accommodate introduction of the fifth ACoAS gene (i.e., the yeast also contained OrfsA, B and C of the Schizochytrium PUFA synthase system and a PPTase (Het I from Nostoc)) using 4 vectors. Yeast expression vectors in which two genes can be cloned (the pESC vectors) were obtained from Stratagene. These vectors are similar to and compatible with the pYES vectors described above. Two genes, native OrfC (nOrfC, SEQ ID NO:5) and HetI (SEQ ID NO:33), were cloned into one pESC vector, while sOrfA (SEQ ID NO:35, sOrfB (SEQ ID NO:36) and the fifth gene (ScACS-1 (SEQ ID NO:82) or ScACS-2 (SEQ ID NO:84)) were cloned into pYES vectors. The four vectors were introduced into yeast and the genes induced by resuspending cells in a galactose-containing medium as describe above. Cells were grown at 30° C. and harvested 18 hours after induction. A summary of the FAME analysis of these cells is shown in Table 1. The control cells contained all 4 vectors, but lacked the gene encoding OrfA. Co-expression of the either one of the ScACOASs resulted in an increase in the accumulation of DHA and DPA n-6 (approximately double the amount in the control cells). This provides confirmation that the accumulation of the products of the PUFA synthase in heterologous host can be increased by co-expression of enzymes that may be more efficient at utilization of those products.

TABLE 1

| 30° C., 18 hr induction Fatty Acid | Control (PUFA genes) FAME (Area %) | ScACS-1 FAME (Area %) | ScACS-2 FAME (Area %) |
| --- | --- | --- | --- |
| C14:0* | 1.7 | 1.8 | 2.0 |
| C14.1 | 0.5 | 0.5 | 0.6 |
| C15:0 | 0.5 | 0.5 | 0.5 |
| C16:0* | 17.1 | 16.5 | 15.5 |
| C16:1* | 40.7 | 38.8 | 38.5 |
| C18:0* | 4.7 | 4.3 | 4.2 |
| C18:1 N9* | 23.8 | 22.4 | 21.9 |
| C18:1 N7 | 1.3 | 1.0 | 1.0 |
| C24:0 | 0.1 | 0.1 | 0.1 |
| C22:5 N6 | 1.3 | 2.5 | 3.1 |
| C26:0 | 1.7 | 1.6 | 1.6 |
| C22:6 N3* | 2.0 | 3.8 | 3.9 |
| DHA plus DPAn-6 | 3.3 | 6.3 | 7.0 |

In subsequent experiments, ScACS-3, ScACS-5, ScACS-6 and ScACS-8 were also tested in yeast that contained the genes encoding the Schizochytrium PUFA synthase system (e.g., sOrfA, sOrfB and nOrfC, and HetI), using similar methods as described above. Expression of each of ScACS-3, ScACS-5, or ScACS-8 all resulted in increased DHA production in yeast as compared to in the absence of the added acyl-CoA synthetase gene (data not shown).

As indicated above, the ScACS-8 shows homology to members of a fatty acid transporter protein family that may also have ACS activity. It is believed that these proteins are associated with the plasma membrane and facilitate import of free fatty acids into the cell and also convert them to the acyl-CoA derivatives. Enzymes of this family may have particular utility when expressing PUFA synthase systems, which release their products as free fatty acids, in the plastids of plant cells. The outer envelope of the plastid is thought to be derived from the plasma membrane and proteins targeted to the plasma membrane (such as ScACS-8) may also be targeted to the plastid outer envelope. If this is the case, these fatty acid transport proteins (such as ScAC-8), may facilitate export of the free fatty acid products of the PUFA synthase from the plastid, and also convert them to the acyl-CoA derivatives. An experiment to provide this acyl-CoA synthetase in plants that express a *Schizochytrium* PUFA PKS system is described below.

Example 10

The following example demonstrates increasing levels of PUFA in yeast expressing the *Schizochytrium* PUFA synthase, without or with ScACoAS-1, by growth in the presence of cerulenin, which inhibits the FAS pathway.

Both the PUFA synthase and FAS utilize malonyl-CoA as the source of carbons for synthesis of their fatty acid products. In addition, the acyl-CoA forms of fatty acids from both systems can serve as substrates for enzymes which synthesize PL and TAG. As discussed above, when both the PUFA synthase and FAS are present in one organism, down regulation or inhibition of the FAS system is expected to favor accumulation of PUFAs. Cerulenin is a well-studied inhibitor of the condensation reactions of fatty acid synthesis. Previous work indicated that PUFA synthases are relatively less sensitive to inhibition by cerulenin than FAS systems.

The present inventors tested the effects of cerulenin on fatty acid profiles of the strains of yeast described in Example 8 as a model of the concept of reduction of FAS activity. The yeast described in Example 9, which also contained an acyl CoA-synthetase, were additionally tested in this system, to determine whether the effects of the two strategies would additively or synergistically increase PUFA production.

Initial experiments indicated the maximum effect (i.e., as an increase in PUFAs as a percentage of the total fatty acid profile) was obtained at a concentration of 4 uM cerulenin. The cerulenin was added 4 hours after transfer to the galactose induction medium. Cells were harvested 19 hr after transfer to induction medium, freeze dried, FAMES prepared and analyzed by GC.

The yeast strains tested were:
Strain 5.5 contained the PUFA synthase genes (sOrfA, sOrfB, OrfC and Het I), as described in Example 8 above; and
Strain 5.6 contained the PUFA synthase gene set of Strain 5.5, plus the ScACoAS-1 (SEQ ID NO:82), as described in Example 9 above.

Referring to Table 2, "0 Cer" indicates cerulenin was not added, and "4 uM Cer" indicates the media was made to 4 uM cerulenin 4 hours after transfer to the induction medium). Each strain was evaluated for fatty acid production in the presence and absence of the cerulenin, to evaluate the effect of the inhibition of the FAS pathway on PUFA production. Table 2 shows the major fatty acids detected in the GC profile (see also FIG. 11). The values are given as a percentage of the total fatty acids detected. DHA and DPAn-6, which are the products of the *Schizochytrium* PUFA PKS system, were the only PUFAs present in the profiles. The sum of DHA plus DPAn-6 is also indicated in Table 2. FIGS. 9 and 10 illustrate the amount of DHA (FIG. 9) or DHA and DPAn-6 (FIG. 10; white bars are DHA; black bars are DHA+DPAn-6) produced by the yeast, as a percentage of total FAME.

Yeast cells without the PUFA synthase genes do not make any detectable PUFAs. Expression of the PUFA synthase system in yeast in this experiment resulted in accumulation of 1.2% DHA. Inclusion of the ScACoA-1 gene (SEQ ID NO:82) increased the DHA level to 4.1%. Growth of the cells with just the PUFA synthase system in the presence of 4 uM cerulenin (inhibition of the FAS system) increased the DHA level to 3.7%. When cells expressing both the PUFA synthase and ScACoAS-1 genes were grown in 4 uM cerulenin (i.e., combined expression of an acyl-CoA synthetase and inhibition of the FAS system), the DHA level increased to 8.2% of total fatty acids. In all of the samples, there was a corresponding increase in DPAn-6 accumulation. The sum of the DHA plus DPA n-6 in the samples is also shown in Table 2 with the greatest amount (14.5% of total fatty acids) present in Strain 5.6 grown in 4 uM cerulenin. It can be seen that the effects of expressing the ACoA synthetase gene and growth in the presence of cerulenin are additive. These data support the invention proposed herein for increasing the accumulation of PUFAs in heterologous hosts.

TABLE 2

| Fatty Acid | Strain 5.5 0 Cer | Strain 5.5 4 uM Cer | Strain 5.6 0 Cer | Strain 5.6 4 uM Cer |
|---|---|---|---|---|
| C14:0 | 1.5 | 0.0 | 1.7 | 0.0 |
| C16:0 | 17.5 | 4.9 | 17.5 | 6.1 |
| C16:1 | 43.4 | 38.4 | 41.7 | 34.8 |
| C18:0 | 5.8 | 3.8 | 5.3 | 4.5 |
| C18:1 N9 | 26.2 | 40.4 | 23.7 | 35.3 |
| C18:1 N7 | 0.9 | 0.8 | 0.0 | 0.6 |
| C22:5 N6 | 0.9 | 2.9 | 2.8 | 6.3 |
| C26:0 | 2.0 | 2.9 | 1.9 | 2.4 |
| C22:6 N3 | 1.3 | 3.7 | 4.1 | 8.2 |
| DHA plus DPA N6 | 2.1 | 6.6 | 6.9 | 14.5 |

Example 11

The following example describes the identification of additional accessory proteins or targets for use in increasing PUFA production and/or accumulation in heterologous hosts.

Enzymes present in *Schizochytrium* efficiently utilize the acyl-CoA forms of the products of the PUFA synthase to synthesize phospholipid (PL) and triacylglycerol (TAG) molecules. However, enzymes present in heterologous hosts may not carry out these reactions with similar efficiency, since those PUFA-CoAs may not typically be encountered by those organisms. For example, expression of PL or TAG synthesis enzymes that efficiently integrate the acyl-CoA products of the various PUFA synthases (e.g., DHA-CoA, DPA n-6-CoA, EPA-CoA, or others) into PL or TAG molecules in those heterologous hosts may result in the increased ability to accumulate those products. In this regard, *Schizochytrium*, or other organisms that produce PUFAs via the PUFA synthase pathway, may serve as a good source of genes encoding those enzymes. Accordingly, the present inventors propose the use of several acyltransferase proteins that utilize PUFA-CoA as substrates in forming PL or TAG (e.g., 3-glycerol-phosphate acyltransferases (GPAT), lysophosphatidic acid acyltransferases (LPAAT) and diacylglycerol acyltransferases (DAGAT)) or other acyltransferases that may result in enrichment of PUFAs in PL or TAG (e.g., phospholipid:diacylglycerol acyltransferases (PDAT)). The identification of several such acyltransferases is described below. A few of the candidates have been tested in yeast and are tested in plants.

DAGAT Enzymes

The present inventors have examined the *Schizochytrium* EST database for those ESTs that show homology to proteins with known (or suspected) DAGAT activities. The inventors identified three candidates as possible DAGAT enzymes for use in conjunction with a PUFA PKS system, one of which is described below and has been shown to be involved in the accumulation of free fatty acids into the TAG molecules in *Schizochytrium*:

*Schizochytrium* DAGAT (also referred to as DAGAT-1 or ScDAGAT-1)—Length of the coding region=1518 nucleotides (not including the stop codon) (SEQ ID NO:100). It is predicted to encode a 506 amino acid (SEQ ID NO:101), 57.4 kDa protein. There is good homology over two thirds of the protein (starting at ~amino acid 170 and continuing to the C-terminus) with proteins identified as DAGAT Type 2B enzymes. A Blast analysis of the first one third of the protein sequence (amino acids 1 through 170) did not reveal significant homology to any proteins and did not detect any Pfam matches.

Using the knock out technology described above in Example 1 for FAS in *Schizochytrium*, the inventors similarly knocked out the DAGAT gene (comprising SEQ ID NO:100) in a *Schizochytrium* strain, denoted B73-8. As shown in FIG. 13, inactivation of the DAGAT gene in *Schizochytrium* significantly inhibited the accumulation of fatty acids in the TAG. Specifically, inactivation of DAGAT resulted in approximately an 80% reduction in mg FAME/gm biomass and approximately a 90% reduction in TAG. Accordingly, the inventors concluded that this DAGAT is the primary enzyme responsible for TAG synthesis in *Schizochytrium*.

Accordingly, it is expected that expression of this nucleic acid molecule in a host (e.g., yeast, plants) expressing a PUFA PKS system described herein will increase the accumulation of free fatty acids into the PL or TAG. A representative experiment expressing this gene in a transgenic plant is described below.

LPAAT Enzymes

The present inventors have also examined the *Schizochytrium* EST database for those ESTs that show homology to proteins with known (or suspected) LPAAT activities. The inventors assembled these into contigs (when two or more overlapping sequences were available) and edited these based on the quality of the individual sequence information as described above. The results of this effort are summarized below. Three different contigs and one singlet (no overlapping sequences in the database) were identified that were particularly good candidates for being associated with LPAAT enzymes. It is recognized that the enzymes encoded by these sequences may have activities related to, but different from, the putative LPAAT activity. In all four cases, a putative Orf (including start and stop codons) were identified. It is recognized that as more data are obtained that the precise sequence representation, including identification of the endogenous start codon, may change.

*Schizochytrium* LPAAT Candidates Identified by Analyses of EST Database:

1. ScLPAAT-1 Contig: Length=1478 nucleotides (SEQ ID NO:102). It appears to include a full-length Orf of 927 nt (including the stop codon, ScLPAAT-1 CDS, SEQ ID NO:103). A Blast search using the translation of the CDS (SEQ ID NO:104) shows there is good homology over most of the encoded protein to known and putative acyltransferase proteins. The best matches are to proteins from *Arabidopsis*. Pfam analysis indicates a large conserved central domain related to the PlsC (1-acyl-sn-glycerol-3-phosphate acyltransferase, i.e., LPAAT) family.

2. ScLPAAT-2 Contig: Length=2112 nucleotides (SEQ ID NO:105). It appears to include a full-length Orf of 1140 nt (including the stop codon, ScLPAAT-2 CDS, SEQ ID NO:106). A Blast search using the translation of the CDS (SEQ ID NO:107) shows there is good homology over most of the encoded protein to known and putative acyltransferase proteins. The best matches are to proteins from *Arabidopsis*. Pfam analysis indicates a large conserved central domain related to the PlsC (1-acyl-sn-glycerol-3-phosphate acyltransferase, i.e., LPAAT) family.

3. ScLPAAT-3 Contig: Length=1862 nucleotides (SEQ ID NO:108). It appears to include a full-length Orf of 1323 nt (including the stop codon, ScLPAAT-3 CDS, SEQ ID NO:109). A Blast search using the translation of the CDS (SEQ ID NO:110) shows there is good homology over the central part of the encoded protein to known and putative acyltransferases. The best matches are to proteins from mammals. Pfam analysis indicates a large conserved central domain related to the PlsC (1-acyl-sn-glycerol-3-phosphate acyltransferase, i.e., LPAAT) family.

4. ScLPAAT-4 singlet: Length=794 nucleotides (SEQ ID NO:111). It appears to include a full-length Orf of 756 nt (including the stop codon, ScLPAAT-4 CDS, SEQ ID NO:112). A Blast search using the translation of the CDS (SEQ ID NO:113) shows there is good homology over much of the encoded protein to known and putative acyltransferases. The best matches are to proteins from birds and mammals. Pfam analysis indicates a large conserved central domain related to the PlsC (1-acyl-sn-glycerol-3-phosphate acyltransferase, i.e., LPAAT) family.

ScLPAAT-1 has been cloned expressed in yeast and plants.

Additional DAGAT or LPAAT Enzymes

The inventors have also examined the *Crypthecodinium cohnii* EST database for those EST's that show homology to proteins with known or suspected DAGAT or LPAAT activities. The results of this effort are summarized below.

A) *Crypthecodinium cohnii* DAGAT Candidates Identified by Analyses of EST Database:

1. CA5_PTA.838.C: Length=817 nucleotides (SEQ ID NO:114). There is good homology over the last 274 nucleotides of this sequence to a Crypthecodinium acyltransferase sequence described in PCT Publication No. WO 2004/087902.

2. CA5_PTA.131.C1: Length=850 nucleotides (SEQ ID NO:115).

3. CA12_cot10_003a_h10: Length=663 nucleotides (SEQ ID NO:116)

4. CA12_cot10_001a_h02: Length=807 nucleotides (SEQ ID NO:117)

5. CA12_cot10_005b_g12: Length=765 nucleotides (SEQ ID NO:118)

6. CA12_cot50_005c_d07: Length=782 nucleotides (SEQ ID NO:119)

B) *Crypthecodinium cohnii* LPAAT Candidates Identified by Analyses of EST Database:

1. CA12_cot10_003a_e11: Length=793 nucleotides (SEQ ID NO:120)

2. CA12_PTA.739.C1: Length=744 nucleotides (SEQ ID NO:121)

Any one or more of the nucleic acid molecules described in this Example can be used to transform any host cell, including to produce any of the genetically modified organisms (e.g., plants or microorganisms) described herein to further enhance PUFA accumulation in an organism, and particularly, in an organism that expresses a PUFA PKS system. These enzymes may also have utility when expressed in a host organism that produces PUFAs by the classical or standard fatty acid synthase pathway. Such constructs can be used alone with the PUFA PKS system or in combination with the other strategies for enhancing PUFA production and accumulation in a host organism as described herein (e.g., with expression of an acyl-CoA synthetase or with inhibition of the FAS pathway). Additional acyltransferase sequences described in PCT Publication No. WO 2004/087902 are also considered to be potentially useful in the present invention and are incorporated herein by reference.

Example 12

The following example describes the expression of genes encoding the *Schizochytrium* PUFA synthase (OrfA, OrfB* and OrfC) along with Het I in *Arabidopsis* and the production of the target PUFAs, DHA and DPAn-6, in the substantial absence of any detectable intermediates or side products.

The *Schizochytrium* OrfA (nucleotide sequence represented by SEQ ID NO:1), OrfB* (nucleotide sequence represented by SEQ ID NO:37) and OrfC (nucleotide sequence represented by SEQ ID NO:5) along with Het I (nucleotide sequence represented by SEQ ID NO:33) were cloned (separately or in various combinations including all 4 genes on one superconstruct) into the appropriate binary vectors for introduction of the genes into plants. Examples of such constructs and vectors are described below (three expression constructs) and also in Example 13 (one "superconstruct" for 4127).

Construction of 5720: Orf B* (Plastidic Expression)

The Orf B* (encoding SEQ ID NO:4), was restriction cloned into an expression cassette under the control of the flax linin promoter/terminator (U.S. Pat. No. 6,777,591). The linin promoter controls the specific-temporal and tissue-specific expression of the transgene(s) during seed development. Directly upstream and in-frame of the *Schizochytrium* Orf B* was the plastid targeting sequence derived from *Brassica napus* acyl-ACP thioesterase (PT-signal peptide), to target Orf B* to the plastid The plant binary vector also contained an existing *E. coli* phosphomannose isomerase gene (Miles and Guest, 1984, Gene 32: 41-48) driven by the ubiquitin promoter/terminator from *Petroselinum crispum* (Kawalleck et al., 1993, Plant Mol. Bio., 21:673-684) between the left and right border sequences for positive selection (Haldrup et al., 1998, Plant Mol. Biol. 37:287-296).

Construction of 4107: HetI and Orf C (Plastidic Expression)

The *Schizochytrium* Orf C (nucleotide sequence represented by SEQ ID NO:5) along with HetI (nucleotide sequence represented by SEQ ID NO:33) were cloned into expression cassettes under the control of a flax linin promoter/terminator (U.S. Pat. No. 6,777,591). The linin promoter controls the specific-temporal and tissue-specific expression of the transgene(s) during seed development. Directly upstream and in-frame of the *Schizochytrium* Orf C and HetI was the plastid targeting sequence derived from *Brassica napus* acyl-ACP thioesterase (PT-signal peptide), to target the PUFA synthase and PPTase to the plastid. Both expression cassettes were then assembled into one plant binary vector containing a pat gene conferring host plant phosphinothricine resistance (Wohlleben et al., 1988, Gene 70:25-37) driven by the ubiquitin promoter/terminator from *Petroselinum crispum* (Kawalleck et al., 1993, Plant Mol. Bio., 21:673-684) between the left and right border sequences.

Construction of 4757: Orf A (Plastidic Expression)

The *Schizochytrium* Orf A (nucleotide sequence represented by SEQ ID NO:1) was cloned into expression cassettes under the control of a flax linin promoter/terminator (U.S. Pat. No. 6,777,591). The linin promoter controls the specific-temporal and tissue-specific expression of the transgene(s) during seed development. Directly upstream and in-frame of the *Schizochytrium* Orf A was the plastid targeting sequence derived from *Brassica napus* acyl-ACP thioesterase (PT-signal peptide), to target the PUFA synthase and PPTase to the plastid. The expression cassette was contained within a plant binary vector containing a nptII gene conferring host plant kanamycin resistance driven by the MAS promoter/terminator between the left and right border sequences.

In one example, transgenes were cloned into three separate expression cassettes: a construct denoted 5720 (containing OrfB*, encoding SEQ ID NO:4), a construct denoted 4107 (containing OrfC, encoding SEQ ID NO:6 and HetI, encoding SEQ ID NO:34) and a construct denoted 4757 (containing OrfA, containing SEQ ID NO:2), as described above. In each construct, the gene was cloned. For directing the proteins to the plastid, additional 5' sequences encoding a plastid targeting sequence derived from a *Brassica napus* acyl-ACP thioesterase were located directly upstream of Orfs A, B*, C and HetI. The amino acid sequence of the encoded targeting peptide is: MLKLSCNVTNHLHTFSFFSDSSLFIPVN-RRTLAVS (SEQ ID NO:81). The nucleotide sequences encoding this peptide were placed in-frame with the start methionine codons of each PUFA synthase Orf, as well as the engineered start codon (ATG) of Het I. In other constructs, where localization of the PUFA synthase was targeted to the cytoplasm of plant cells, no additional protein encoding sequences were appended to the 5' end of the Orfs.

Standard methods were used for introduction of the genes into *Arabidopsis* (floral dipping into suspension of *Agrobacterium* strains containing the appropriate vectors, as described in Clough et al., 1998, Plant J. 16: 735-743). The details of the methods are described in Example 13 below. Seeds obtained from those plants were plated on selective medium and allowed to germinate. Some of the plants that grew were taken to maturity and the seeds analyzed for PUFA content. Based on PUFA content some of those seeds were taken forward to the next generation. Pooled seeds obtained from those plants were analyzed for their fatty acid content. The target PUFAs expected from these transgenic plants were docosahexaenoic acid (DHA) and docosapentaenoic acid (DPAn-6), which are the primary PUFAs produced by the *Schizochytrium* PUFA PKS system from which the genes used to transform the plants were derived.

Results from one exemplary fatty acid analysis in one of the exemplary transgenic plant lines is shown in FIG. 13. The top panel of FIG. 13 shows the typical fatty acid profile of wild type *Arabidopsis* seeds as represented by GC separation and FID detection of FAMEs prepared from a pooled seed sample. The predominant fatty acids are: 16:0, 18:0, 16:1, 18:1, 20:1, 20:2 and 22:1. No DHA or DPA n-6 are present in the samples from wild type seed.

The lower panel of FIG. 13 shows the fatty acid profile of a pooled seed sample from one of the exemplary transgenic *Arabidopsis* lines (line 263) expressing the *Schizochytrium* PUFA synthase genes and the Het I gene, introduced from three separate expression cassettes (5720, 4107 and 4757) all targeted to the plastid, as described above. Referring to the fatty acid profile of Line 263, it is readily observed that two FAME peaks are present in the profile from the transgenic plant seeds that are not present in the profile from wild type seeds. The elution pattern of these two peaks exactly corresponds to the elution of authentic DHA and DPAn-6 (using FAMEs prepared from *Schizochytrium* oil as standards, as well as a commercially purchased DHA standard from NuCheck Prep). In this particular example, the DHA peak represents 0.8% of total calculated FAMEs while the DPA n-6 peak represents 1.7%. The sum of novel PUFAs is 2.5% of total FAMEs.

Experiments with other transgenic plant lines yielded similar results. For example, another transgenic line, denoted 269, which was transformed with the same constructs and in the same manner as the 263 line, produced approximately 0.75% DHA or total calculated FAMEs, and 1.41% DPAn-6 of total calculated FAMEs) (data not shown).

Moreover, multiple other transgenic *Arabidopsis* plants produced using the same nucleic acid molecules described above also produced the target PUFAs, regardless of whether they were produced using constructs providing the PUFA PKS genes and the HetI PPTase on separate constructs, combination constructs, or a single superconstruct (data shown below in Example 13).

In addition, transgenic plants targeting the PUFA PKS genes to the cytosol all expressed the target PUFAs (data not shown in detail). For example, a plant line expressing the *Schizochytrium* PUFA PKS plus HetI in the cytosol introduced on three separate expression cassettes as described above (without the plastid targeting sequence) produced approximately 0.45% DHA and approximately 0.8% DPA as a percentage of total FAME. In another example, a plant line expressing the *Schizochytrium* PUFA PKS plus HetI in the cytosol introduced on a single superconstruct (similar to that described in Example 13 below) produced approximately 0.2-0.3% DHA and approximately 0.5% DPA as a percentage of total FAME.

The appearance of DHA and DPAn-6 in the seed fatty acid profile shown in FIG. 13 (and as observed in other transgenic lines, some of which are described above) demonstrates that introduced *Schizochytrium* PUFA synthase system functions when expressed in the plant cell and that the proteins can be targeted to the plastid. In addition, the inventors have confirmed that the proteins can also be targeted to the cytosol, or both the plastid and the cytosol, and produce PUFAs. As predicted from the biochemical and heterologous expression data in other hosts (e.g., in *E. coli* and in yeast) the only novel fatty acids detected in the profile of the seed from the transgenic plants are DHA and DPAn-6 (i.e., the fatty acid profile is substantially free of contaminating intermediate or side products resulting from the PUFA production enzyme system), further illustrating the advantages of the PUFA PKS system over the standard pathway enzymes for the production of PUFAs in a plant.

Examples 13(a)-13(j)

The following examples describe the use of various strategies described herein (including combinations of strategies) for increasing the production and/or accumulation of PUFAs in plants.

Specifically, the following examples describe the expression of genes encoding the *Schizochytrium* PUFA synthase (nOrfA, Orf B* and nOrfC) along with Het I in *Arabidopsis* seeds, alone or in combination with other accessory proteins and/or genetic modification strategies to enhance PUFA production and accumulation. Specifically, the *Schizochytrium* PUFA synthase and Het I are expressed in plants alone or in combination with: (1) a gene encoding an acyl-CoA synthetase (ACS), or (2) with genetic elements intended to inhibit endogenous FAS activity. In addition, an example of the combined use of the *Schizochytrium* PUFA synthase and Het I in combination with expression of an ACS gene and a genetic element intended to inhibit endogenous FAS activity is shown. Finally, examples of expression of acyltransferases, including DAGAT and/or LPAAT, alone or in combination with the expression of one or more acyl-CoA synthetases and genetic elements intended to inhibit endogenous FAS activity are described below. The strategies outlined here illustrate the ability to enact of any of the concepts described in the previous examples in plants.

Materials and Methods for Example 13(a)-(j)

(1) Constructs

Construction of Construct 4127: PT-Signal Peptide:nORFA, PT-Signal Peptide:nORFB*, PT-Signal Peptide:HetI, PT-Signal Peptide:nORFC (Plastid Targeted Expression of *Schizochytrium* PUFA Synthase with HetI)

The *Schizochytrium* native OrfA (nOrfA, represented by SEQ ID NO:1, encoding SEQ ID NO:2), synthetic (resynthesized) OrfB* (OrfB*, represented by SEQ ID NO:37 and encoding SEQ ID NO:4) and native OrfC (nOrfC, represented by SEQ ID NO:5 and encoding SEQ ID NO:6), along with HetI from *Nostoc* (represented by SEQ ID NO:33 and encoding SEQ ID NO:34) were cloned into expression cassettes under the control of a flax linin promoter/terminator (see U.S. Pat. No. 6,777,591 with regard to the promoter/terminator). The linin promoter controls the specific-temporal and tissue-specific expression of the transgene(s) during seed development. Directly upstream and in-frame of the *Schizochytrium* Orfs A, B*, C and HetI was the plastid targeting sequence derived from *Brassica napus* acyl-ACP thioesterase (referred to herein as a PT-signal peptide, the amino acid sequence of which is represented by SEQ ID NO:81), also described in Example 12, to target the PUFA synthase and PPTase to the plastid. All four expression cassettes were then assembled into one plant binary vector containing a pat gene conferring host plant phosphinothricine resistance (Wohlleben et al., 1988, *Gene* 70:25-37) driven by the ubiquitin promoter/terminator from *Petroselinum crispum* (Kawalleck et al., 1993, *Plant Mol. Bio.*, 21:673-684) between the left and right border sequences.

Construction of 5723: ACS-1 (Cytosolic Expression)

For expression of an acyl-CoA synthetase, a separate plant binary vector was constructed to express the nucleic acid sequence for *Schizochytrium* ACS-1 (SEQ ID NO:82, encoding SEQ ID NO:83). The ACS-1, with appropriate restriction sites engineered at the 5' and 3' ends was sub-cloned and sequenced. The ACS-1 was then restriction cloned into an expression cassette under the control of the flax linin promoter/terminator (U.S. Pat. No. 6,777,591) into a plant binary vector containing the *E. coli* phosphomannose isomerase gene (Miles and Guest, 1984, Gene 32:+41-48) driven by the ubiquitin promoter/terminator from *Petroselinum crispum* (Kawalleck et al., 1993, Plant Mol. Bio., 21:673-684) between the left and right border sequences for positive selection (Haldrup et al., 1998, Plant Mol. Biol. 37:287-296).

Similar constructs were also produced for the expression of the acyl-CoA synthetases referred to herein as ACS-2 (SEQ ID NO:84/85) and ACS-8 (SEQ ID NO:96/97), 5724 and 5730 respectively. In one aspect, the acyl-CoA synthetase sequences were combined with nucleic acid molecules encoding a DAGAT (SEQ ID NO:100/101) and/or LPAAT (SEQ ID NO:102/103/104), as described below.

Construction of 5727: KAS II RNAi with CHSA Intron (Cytosolic Expression of KAS II RNAi with Intron)

For FAS inhibition, a separate plant binary vector was constructed to attenuate the expression of KAS II. In this case, a 499 bp region of the nuclear encoded KAS II transcript encoded by the At1g74960 locus (Carlsson et al., 2002, Plant J. 29: 761-770) was targeted by RNA interference (RNAi) with an intervening intron derived from the petunia chalcone synthase A (CHSA) gene (McGinnis et al., 2005, Methods in Enzymology 392:1-24; Koes et al., 1989, Gene 81: 245-257). The KAS II RNAi with CHSA intron (represented by SEQ ID NO:122) was cloned into a plant binary vector between the linin promoter/terminator (U.S. Pat. No. 6,777,591) in a plant binary vector containing the *E. coli* phosphomannose isomerase gene (Miles and Guest, 1984, Gene 32: 41-48) driven by the ubiquitin promoter/terminator from *Petroselinum crispum* (Kawalleck et al., 1993, Plant Mol. Bio., 21:673-684) between the left and right border sequences for positive selection (Haldrup et al., 1998, Plant Mol. Biol. 37:287-296).

Construction of 5729: KAS III Antisense RNA (Cytosolic Expression of KAS III Antisense RNA)

For FAS inhibition, a separate plant binary vector was constructed to attenuate the expression of KAS III. In this case, a 1210 bp antisense KAS III sequence derived from the nuclear encoded transcript encoded by the At1g62640 locus (Yamada et al., 2002, GenBank Accession AY091275) was targeted. The KAS III antisense sequence (represented herein by SEQ ID NO:125) was cloned into a plant binary vector between the linin promoter/terminator (U.S. Pat. No. 6,777, 591) in a plant binary vector containing the phosphomannose isomerase gene (Miles and Guest, 1984, Gene 32: 41-48) driven by the ubiquitin promoter/terminator from *Petroselinum crispum* (Kawalleck et al., 1993, Plant Mol. Bio., 21:673-684) between the left and right border sequences for positive selection (Haldrup et al., 1998, Plant Mol. Biol. 37:287-296).

Construction of 5731: ACS-1 and KAS II RNAi with Intron (Cytosolic Expression)

For expression of an acyl-CoA synthetase combined with FAS inhibition, a separate plant binary vector was constructed to attenuate the expression of KAS II and to express the nucleic acid sequence for *Schizochytrium* ACS-1 (SEQ ID NO:82, encoding SEQ ID NO:83). For this construct a double expression cassette of ACS-1 and KAS II RNAi with intron were expressed under the control of the flax linin promoter/terminator (U.S. Pat. No. 6,777,591) into a plant binary vector containing the *E. coli* phosphomannose isomerase gene (Miles and Guest, 1984, Gene 32: 41-48) driven by the ubiquitin promoter/terminator from *Petroselinum crispum* (Kawalleck et al., 1993, Plant Mol. Bio., 21:673-684) between the left and right border sequences for positive selection (Haldrup et al., 1998, Plant Mol. Biol. 37:287-296).

Construction of 5732: ACS-1 and Antisense KAS II (Cytosolic Expression)

For expression of an acyl-CoA synthetase combined with FAS inhibition, a separate plant binary vector was constructed to attenuate the expression of KAS II and to express the nucleic acid sequence for *Schizochytrium* ACS-1 (SEQ ID NO:82, encoding SEQ ID NO:83). For this construct a double expression cassette of ACS-1 and KAS II antisense with intron (KASII antisense sequence represented herein by SEQ ID NO:123) were expressed under the control of the flax linin promoter/terminator (U.S. Pat. No. 6,777,591) into a plant binary vector containing the *E. coli* phosphomannose isomerase gene (Miles and Guest, 1984, Gene 32: 41-48) driven by the ubiquitin promoter/terminator from *Petroselinum crispum* (Kawalleck et al., 1993, Plant Mol. Bio., 21:673-684) between the left and right border sequences for positive selection (Haldrup et al., 1998, Plant Mol. Biol. 37:287-296).

Construction of 5733: ACS-1 and KAS III RNAi (Cytosolic Expression)

For expression of an acyl-CoA synthetase combined with FAS inhibition, a separate plant binary vector was constructed to attenuate the expression of KAS III and to express the nucleic acid sequence for *Schizochytrium* ACS-1 (SEQ ID NO:82, encoding SEQ ID NO:83). For this construct a double expression cassette of ACS-1 and KAS III RNAi (KASIII RNAi sequence represented herein by SEQ ID NO:124) were expressed under the control of the flax linin promoter/terminator (U.S. Pat. No. 6,777,591) into a plant binary vector containing the *E. coli* phosphomannose isomerase gene (Miles and Guest, 1984, Gene 32: 41-48) driven by the ubiquitin promoter/terminator from *Petroselinum crispum* (Kawalleck et al., 1993, Plant Mol. Bio., 21:673-684) between the left and right border sequences for positive selection (Haldrup et al., 1998, Plant Mol. Biol. 37:287-296).

Construction of 5734: ACS-1 and KAS III Antisense RNA (Cytosolic Expression)

For expression of an acyl-CoA synthetase combined with FAS inhibition, a separate plant binary vector was constructed to attenuate the expression of KAS III and to express the nucleic acid sequence for *Schizochytrium* ACS-1 (SEQ ID NO:82, encoding SEQ ID NO:83). For this construct a double expression cassette of ACS-1 and KAS III antisense was expressed under the control of the flax linin promoter/terminator (U.S. Pat. No. 6,777,591) into a plant binary vector containing the *E. coli* phosphomannose isomerase gene (Miles and Guest, 1984, Gene 32: 41-48) driven by the ubiquitin promoter/terminator from *Petroselinum crispum* (Kawalleck et al., 1993, Plant Mol. Bio., 21:673-684) between the left and right border sequences for positive selection (Haldrup et al., 1998, Plant Mol. Biol. 37:287-296).

Construction of 4793: DAGAT

For expression of a DAGAT, a separate plant binary vector was constructed to express the nucleic acid sequence for *Schizochytrium* DAGAT-1 (SEQ ID NO:100, encoding SEQ ID NO:101). The *Schizochytrium* DAGAT (nucleotide sequence represented by SEQ ID NO:100) was cloned into expression cassettes under the control of a flax linin promoter/terminator (U.S. Pat. No. 6,777,591). The linin promoter controls the specific-temporal and tissue-specific expression of the transgene(s) during seed development. The expression cassette was contained within a plant binary vector containing a nptII gene conferring host plant kanamycin resistance driven by the MAS promoter/terminator between the left and right border sequences.

Construction of 4794: DAGAT and ACS-8

For expression of a DAGAT and an acyl-CoA synthetase, a separate plant binary vector was constructed to express: (1) the nucleic acid sequence for *Schizochytrium* DAGAT (SEQ ID NO:100, encoding SEQ ID NO:101, and (2) the nucleic acid sequence for *Schizochytrium* ACS-8 (SEQ ID NO:96, encoding SEQ ID NO:97). For this construct a double expression cassette of ACS-8 and DAGAT was expressed under the control of the flax linin promoter/terminator (U.S. Pat. No. 6,777,591) into a plant binary vector containing a nptII gene conferring host plant kanamycin resistance driven by the MAS promoter/terminator between the left and right border sequences.

Construction of 4795: LPAAT and DAGAT

For expression of an LPAAT and a DAGAT, a separate plant binary vector was constructed to express: (1) the nucleic acid sequence for *Schizochytrium* LPAAT (SEQ ID NO:103, encoding SEQ ID NO:104, and (2) the nucleic acid sequence for *Schizochytrium* DAGAT-1 (SEQ ID NO:100, encoding SEQ ID NO:101). For this construct a double expression cassette of LPAAT and DAGAT was expressed under the control of the flax linin promoter/terminator (U.S. Pat. No. 6,777,591) into a plant binary vector containing a nptII gene conferring host plant kanamycin resistance driven by the MAS promoter/terminator between the left and right border sequences.

Construction of 4796: ACS-8, LPAAT, and DAGAT

For expression of an acyl-CoA synthetase, LPAAT and DAGAT, a separate plant binary vector was constructed to express: (1) the nucleic acid sequence for *Schizochytrium* LPAAT (SEQ ID NO:103, encoding SEQ ID NO:8104, (2) the nucleic acid sequence for *Schizochytrium* DAGAT-1 (SEQ ID NO:100, encoding SEQ ID NO:101), and (3) the nucleic acid sequence for *Schizochytrium* ACS-8 (SEQ ID NO:96, encoding SEQ ID NO:97). For this construct a triple expression cassette of ACS-8, LPAAT and DAGAT was expressed under the control of the flax linin promoter/terminator (U.S. Pat. No. 6,777,591) into a plant binary vector containing a nptII gene conferring host plant kanamycin resistance driven by the MAS promoter/terminator between the left and right border sequences.

(2) Transformation of *Arabidopsis*

The integrity of all plant binary vectors were confirmed by diagnostic restriction digests and sequence analysis. Isolated plasmids were then used to transform competent *Agrobacterium* strain EH101 (Hood et al., 1986, J. Bacteriol. 144: 732-743) by electroporation (25 μF, 2.5 kV, 200Ω). Recombinant *Agrobacterium* were plated on AB-spectinomycin/kanamycin (20×AB salts, 2 M glucose, 0.25 mg/ml FeSo$_4$.7H$_2$O, 1 M MgSo$_4$, 1 M CaCl$_2$) and a single colony was used to inoculate 5 ml of AB-spectinomycin/kanamycin broth. These cultures were grown overnight at 28° C. The recombinant *Agrobacteria* containing the 4127 plasmid were then used to transform wild type C24 *Arabidopsis thaliana* plants by the flower dipping method (Clough et al., 1998, Plant J. 16: 735-743). Seeds obtained from these plants were plated on selective medium in the presence of phosphinothricine and allowed to germinate. Positively identified seedlings were transferred to soil and taken to maturity, after which the seeds were analyzed for PUFA content.

For recombinant *Agrobacterium* containing the other plasmids (5723, 5724, 5730, 5727, 5729, 5731, 5732, 5733, 5734, 4793, 4794, 4795, and/or 4796), transgenic 4127-Line 150 *Arabidopsis thaliana* plants were re-transformed by the flower dipping method (Clough et al., 1998, *Plant J.* 16: 735-743). Seeds obtained from these plants were plated on selective medium in the presence of phosphinothricine and mannose for double selection or phosphinothricine, mannose and kanamycin or phosphinothricine and kanamycin for triple selection, where appropriate, and allowed to germinate. Positively identified seedlings were transferred to soil and taken to maturity, after which the seeds were analyzed for PUFA content.

Example 13a

This example describes production of DHA and DPAn-6 in transgenic *Arabidopsis thaliana* seed expressing the *Schizochytrium* PUFA synthase (OrfA, OrfB* and OrfC) along with Het I on a superconstruct (4127).

GC-FAME analyses of pooled seeds from *Arabidopsis* plants expressing the *Schizochytrium* PUFA synthase (OrfA, OrfB* and OrfC) along with Het I (construct 4127) revealed significant levels of the target PUFAs, DHAn-3 and DPAn-6, in their fatty acid content. As shown in Table 3, one line in particular (4127-Line 150) exhibited 0.6% DHAn-3 and 0.7% DPAn-6 for a combined 1.3% *Schizochytrium*-type PUFA content. As expected, the control seeds from the wild type (C24) background do not contain any detectable levels of either DHAn-3 or DPAn-6. Subsequent expression analysis of 4127-Line 150 performed by SDS-PAGE and Western blotting revealed the recombinant seed expressed OrfA, OrfB*, OrfC and Het I correctly targeted to the plastid (data not shown). Furthermore, this phenotype was stable from analysis of the T2 generation through until the analysis of the T4 generation, which served as a positive control for determining if DHA and *Schizochytrium* PUFA levels when various strategies described herein (including combinations of strategies) were evaluated for increasing the production and/or accumulation of PUFAs in plants.

TABLE 3

DHA and DPA levels in mature wild type *Arabidopsis* seed in comparison to transgenic seed expressing the *Schizochytrium* PUFA synthase along with HetI (plastid targeted) in T2 and T4 pooled seeds populations selected from phosphinothricine positive plants. The % DHAn-3 and % DPAn-6 were determined following GC separation and FID detection of total calculated FAMEs.

| | | | | Phenotype | | |
| --- | --- | --- | --- | --- | --- | --- |
| Strategy | Genotype | Line | Generation | % DHA (C22:6 n-3) | % DPA (C22:5 n-6) | % DHA + DPA |
| Negative control | Wild Type (pooled seed) | C24 ecotype | N/A | 0 | 0 | 0 |
| PUFA Synthase + HetI | OrfA, OrfB*, OrfC, HetI (pooled seed) | 4127-Line 150 | T2 | 0.6 | 0.7 | 1.3 |
| | | | T4 | 0.6 | 0.6 | 1.2 |

Example 13b

This example describes the production of DHAn-3 and DPAn-6 in transgenic *Arabidopsis thaliana* seed expressing the *Schizochytrium* PUFA synthase (OrfA, OrfB* and OrfC) with Het I (4127) in combination with the *Schizochytrium* ScACS-1 gene (5723) or ScACS-2 gene (5724).

Plants derived from 4127-Line 150 (see Example 13a) were used for the introduction of the ScACS-1 construct (5723) or ScACS-2 construct (5724) by *Agrobacterium*-mediated transformation as described above. Following the selection of recombinant plants in the presence of both phosphinothricine and mannose, seeds were harvested and analyzed for fatty acid profiles by GC separation and FID detection of FAMES prepared from pooled seed.

As an example, one line in particular expressing the *Schizochytrium* PKS along with HetI in combination with ACS-1 (4127/5723-Line 514) exhibited 1.5% DHA and 0.9% DPAn-6 for a combined 2.4% *Schizochytrium* PUFA content in the total fatty acid profile (Table 4). This represented a 2.5 fold increase in DHAn-3 content over the 4127-Line 150 positive control. Similar results were observed in a line which expressed the *Schizochytrium* PKS along with HetI in combination with ACS-2 (4127/5724-Line 552) which exhibited a 1.8 fold increase in DHAn-3 content in comparison to the positive control. Furthermore, a shift in the DHA to DPA ratio from approximately 0.85:1.0 in the T2 generation or 1.0:1.0 in the T4 generation of 4127-Line 150 to 1.7:1.0 in the ACS-1 and 1.2:1.0 in the ACS-2 lines was observed. In all transgenic seed analyzed, the only novel fatty acids detected in the profile were DHA n-3 or DPA n-6.

TABLE 4

DHAn-3 and DPAn-6 levels in mature wild type and transgenic
Arabidopsis seed expressing the Schizochytrium PUFA synthase along
with Hetl (plastid targeted) in comparison to transgenic seed
combining Schizochytrium PUFA synthase along with Hetl (plastid
targeted) expression and with expression of Schizochytrium ACS-1 or
ACS-2, in pooled seeds. The % DHA n-3 and % DPA n-6 were determined
following GC separation and FID detection of total calculated FAMEs.

| | | | | Phenotype | | |
|---|---|---|---|---|---|---|
| Strategy | Genotype | Line | Generation | % DHA (C22:6 n-3) | % DPA (C22:5 n-6) | % DHA + DPA |
| Negative control | Wild Type (pooled seed) | C24 ecotype | N/A | 0 | 0 | 0 |
| Positive Control | OrfA, OrfB*, OrfC, Hetl (pooled seed) | 4127- Line 150 | T2 T4 | 0.6 0.6 | 0.7 0.6 | 1.3 1.2 |
| AcylCoAS Expression | OrfA, OrfB*, OrfC, Hetl, ACS-1 (pooled seed) | 4127/5723- Line 514 | T4/T2 | 1.5 | 0.9 | 2.4 |
| | OrfA, OrfB*, OrfC, Hetl, ACS-2 (pooled seed) | 4127/5724- Line 552 | | 1.1 | 0.9 | 2.0 |

Example 13c

This example describes the production of DHA and DPAn-6 in transgenic *Arabidopsis thaliana* seed expressing the *Schizochytrium* PUFA synthase (OrfA, OrfB* and OrfC) along with Het I, combined with FAS inhibition through the attenuation of KAS II using RNA interference (RNAi).

Plants derived from 4127-Line 150 were used for the introduction of the KAS II RNAi with intron (construct 5727) by *Agrobacterium*-mediated transformation as described above. Following the selection of recombinant plants in the presence of both phosphinothricine and mannose, seeds were harvested and analyzed for fatty acid profiles by GC separation and FID detection of FAMES prepared from pooled seed.

As an example, one line in particular (4127/5727-Line 1097) exhibited 1.3% DHA n-3 and 1.2% DPA n-6 for a combined 2.5% *Schizochytrium* PUFA content in the total fatty acid profile (Table 5). This represented more than a 2.1 fold increase in DHA content over the 4127-Line 150 positive control. Subsequently, single-seeds from 4127/5727-Line 1097 were individually analyzed by GC separation and FID detection of total calculated FAMEs.

Following this analysis it was observed that seed within this population exhibited up 25 to 2.0% DHAn-3 and 1.6% DPAn-6 for a combined 3.6% *Schizochytrium* PUFA content in the fatty acid profile (Table 5). This represents a 3.3 fold increase in DHA content and a 3-fold increase in *Schizochytrium* PUFA content over the 4127-Line 150 positive control. Furthermore, a shift in the DHA to DPA ratio from 0.85:1.0 in the T2 generation or 1.0:1.0 in the T4 generation of 4127-Line 150 to 1.25:1.0 or greater in the FAS inhibition line was observed. The single seed average was consistent with the pooled sample with respect to % DHA n-3, % DPA n-6 and total % (DHA+DPA) and differences within this population can be attributed to segregation of the recombinant 4127 and 5727 loci in co-transformed seed. In all transgenic seed analyzed, the only novel fatty acids detected in the profile were DHA n-3 or DPA n-6.

TABLE 5

DHA and DPA levels in mature wild type and transgenic *Arabidopsis*
seed expressing the *Schizochytrium* PUFA synthase along with Hetl
(plastid targeted) in comparison to transgenic seed combining
*Schizochytrium* PUFA synthase along with Hetl (plastid targeted)
expression with KAS II attenuation in pooled and single seeds. The
% DHA n-3 and % DPA n-6 were determined following GC separation and
FID detection of total calculated FAMEs.

| | | | | Phenotype | | |
|---|---|---|---|---|---|---|
| Strategy | Genotype | Line | Generation | % DHA (C22:6 n-3) | % DPA (C22:5 n-6) | % DHA + DPA |
| Negative control | Wild Type (pooled seed) | C24 ecotype | N/A | 0 | 0 | 0 |
| Positive Control | OrfA, OrfB*, OrfC, Hetl (pooled seed) | 4127- Line 150 | T2 T4 | 0.6 0.6 | 0.7 0.6 | 1.3 1.2 |
| FAS inhibition | OrfA, OrfB*, OrfC, Hetl, KAS II RNAi with intron (pooled seed) | 4127/5727- Line 1097 | T4/T2 | 1.3 | 1.2 | 2.5 |

TABLE 5-continued

DHA and DPA levels in mature wild type and transgenic *Arabidopsis* seed expressing the *Schizochytrium* PUFA synthase along with HetI (plastid targeted) in comparison to transgenic seed combining *Schizochytrium* PUFA synthase along with HetI (plastid targeted) expression with KAS II attenuation in pooled and single seeds. The % DHA n-3 and % DPA n-6 were determined following GC separation and FID detection of total calculated FAMEs.

| Strategy | Genotype | Line | Generation | Phenotype % DHA (C22:6 n-3) | % DPA (C22:5 n-6) | % DHA + DPA |
|---|---|---|---|---|---|---|
| | OrfA, OrfB*, OrfC, HetI, KAS II RNAi with intron (single seed) | 1097-7 | | 0.7 | 0.7 | 1.4 |
| | | 1097-9 | | 0.7 | 0.8 | 1.5 |
| | | 1097-2 | | 0.9 | 0.9 | 1.8 |
| | | 1097-5 | | 1.0 | 0.9 | 1.9 |
| | | 1097-6 | | 1.0 | 1.1 | 2.1 |
| | | 1097-1 | | 1.2 | 1.3 | 2.5 |
| | | 1097-8 | | 1.3 | 1.3 | 2.6 |
| | | 1097-4 | | 1.4 | 0.8 | 2.2 |
| | | 1097-10 | | 1.4 | 1.2 | 2.6 |
| | | 1097-3 | | 2.0 | 1.6 | 3.6 |
| | | Single seed average | T4/T2 | 1.2 | 1.0 | 2.2 |

Example 13d

This example describes the production of DHA and DPAn-6 in transgenic *Arabidopsis thaliana* seed expressing the *Schizochytrium* PUFA synthase (OrfA, OrfB* and OrfC) along with Het I, combined with FAS inhibition through the attenuation of KAS III using antisense RNA.

Plants derived from 4127-Line 150 were used for the introduction of the KAS III antisense construct (5129) by *Agrobacterium*-mediated transformation as described above. Following the selection of recombinant plants in the presence of both phosphinothricine and mannose, seeds were harvested and analyzed for fatty acid profiles by GC separation and FID detection of FAMES prepared from pooled seed.

As an example, one line in particular (4127/5729-Line 1087) exhibited 1.7% DHA n-3 and 1.2% DPA n-6 for a combined 2.9% *Schizochytrium* PUFA content in the total fatty acid profile (Table 6). This represented a 2.8 fold increase in DHA content over the 4127-Line 150 positive control.

Subsequently, single-seeds from 4127/5729-Line 1087 were individually analyzed by GC separation and FID detection of total calculated FAMEs. Following this analysis it was observed that seed within this population exhibited up to 2.4% DHA n-3 and 1.8% DPA n-6 for a combined 4.2% *Schizochytrium* PUFA content in the fatty acid profile (Table 6). This would represent a 4 fold increase in DHA content and 3.2 fold increase in *Schizochytrium* PUFA content over the 4127-Line 150 positive control. Furthermore, a shift in the DHA to DPA ratio from 0.85:1.0 in the T2 generation or 1.0:1.0 in the T4 generation of 4127-Line 150 to 1.33:1.0 or greater in the FAS inhibition line was observed. The single seed average was consistent with the pooled sample with respect to % DHA n-3, % DPA n-6 and total % (DHA+DPA) and differences within this population can be attributed to segregation of the recombinant 4127 and 5729 loci in co-transformed seed. In all transgenic seed analyzed the only novel fatty acids detected in the profile were DHA n-3 or DPA n-6 as predicted from the previous biochemical and heterologous expression data observed in *E. coli* and yeast. The GC-FAME chromatogram obtained for analysis of the seed sample 1087-7 is shown for reference in FIG. 14.

TABLE 6

DHA and DPA levels in mature wild type and transgenic *Arabidopsis* seed expressing the *Schizochytrium* PUFA synthase along with HetI (plastid targeted) in comparison to transgenic seed combining *Schizochytrium* PUFA synthase along with HetI (plastid targeted) expression with KAS III attenuation in pooled and single seeds. The % DHA n-3 and % DPA n-6 were determined following GC separation and FID detection of total calculated FAMEs.

| Strategy | Genotype | Line | Generation | Phenotype % DHA (C22:6 n-3) | % DPA (C22:5 n-6) | % DHA + DPA |
|---|---|---|---|---|---|---|
| Negative control | Wild Type (pooled seed) | C24 ecotype | N/A | 0 | 0 | 0 |
| Positive Control | OrfA, OrfB*, OrfC, HetI (pooled seed) | 4127-Line 150 | T2 | 0.6 | 0.7 | 1.3 |
| | | | T4 | 0.6 | 0.6 | 1.2 |

TABLE 6-continued

DHA and DPA levels in mature wild type and transgenic *Arabidopsis* seed expressing the *Schizochytrium* PUFA synthase along with Hetl (plastid targeted) in comparison to transgenic seed combining *Schizochytrium* PUFA synthase along with Hetl (plastid targeted) expression with KAS III attenuation in pooled and single seeds. The % DHA n-3 and % DPA n-6 were determined following GC separation and FID detection of total calculated FAMEs.

| | | | | Phenotype | | |
|---|---|---|---|---|---|---|
| Strategy | Genotype | Line | Generation | % DHA (C22:6 n-3) | % DPA (C22:5 n-6) | % DHA + DPA |
| FAS inhibition | OrfA, OrfB*, OrfC, Hetl, KAS III antisense RNA (pooled seed) | 4127/5729-Line 1087 | T4/T2 | 1.7 | 1.2 | 2.9 |
| | OrfA, OrfB*, OrfC, Hetl, KAS III antisense RNA (single seed) | 1087-9 | | 0.9 | 1.0 | 1.9 |
| | | 1087-4 | | 1.0 | 1.1 | 2.1 |
| | | 1087-2 | | 1.1 | 0.9 | 2.0 |
| | | 1087-6 | | 1.2 | 0.6 | 1.8 |
| | | 1087-1 | | 1.3 | 1.1 | 2.4 |
| | | 1087-8 | | 1.4 | 1.5 | 2.9 |
| | | 1087-3 | | 1.7 | 1.1 | 2.8 |
| | | 1087-10 | | 1.8 | 1.6 | 3.4 |
| | | 1087-5 | | 2.0 | 1.6 | 3.6 |
| | | 1087-7 | | 2.4 | 1.8 | 4.2 |
| | | Single seed average | T4/T2 | 1.5 | 1.2 | 2.7 |

Example 13e

This example describes the production of DHA and DPAn-6 in transgenic *Arabidopsis thaliana* seed expressing the *Schizochytrium* PUFA synthase (OrfA, OrfB* and OrfC) along with Het I, combined with both expression of the ScACS-1 gene and FAS inhibition through the attenuation of KAS III using antisense RNA.

Plants derived from 4127-Line 150 were used for the introduction of the ScACS-1 plus KAS II RNAi using construct 5731 by *Agrobacterium*-mediated transformation as described above. Following the selection of recombinant plants in the presence of both phosphinothricine and mannose, seeds were harvested and analyzed for fatty acid profiles by GC separation and FID detection of FAMES prepared from pooled seed.

As an example, one line (4127/5731-Line 1366) exhibited 1.9% DHA and 1.9% DPA n-6 for a combined 3.8% *Schizochytrium* PUFA content in the total fatty acid profile (Table 7). This represented a 3.2 fold increase over the 4127-Line 150 positive control, a 1.3 fold increase over the ACS-1 strategy alone as observed in 4127/5723-Line 514 and a 1.5 fold increase compared to the KAS II RNAi attenuation strategy alone as observed in 4127/5727-Line 1097 when comparing DHA content from pooled seed populations as described in examples 13b and 13c (Tables 4 and 5), respectively.

One would expect higher levels of DHA content to be observed in single seeds within this population as a reflection of segregation of the 4127 and 5731 loci amongst the pooled seed. In all transgenic seed analyzed the only novel fatty acids detected in the profile were DHA n-3 or DPA n-6 as predicted from the previous biochemical and heterologous expression data observed in *E. coli* and yeast. The GC-FAME chromatogram obtained for analysis of the pooled seed sample 4127/5731-Line 1366 is shown for reference in FIG. 15.

TABLE 7

DHAn-3 and DPAn-6 levels in mature wild type and transgenic *Arabidopsis* seed expressing the *Schizochytrium* PUFA synthase along with Hetl (plastid targeted) in comparison to transgenic seed combining *Schizochytrium* PUFA synthase along with Hetl (plastid targeted) combined with expression of *Schizochytrium* ACS-1 and FAS inhibition, in pooled seeds. The % DHA n-3 and % DPA n-6 were determined following GC separation and FID detection of total calculated FAMEs.

| | | | | Phenotype | | |
|---|---|---|---|---|---|---|
| Strategy | Genotype | Line | Generation | % DHA (C22:6 n-3) | % DPA (C22:5 n-6) | % DHA + DPA |
| Negative control | Wild Type (pooled seed) | C24 ecotype | N/A | 0 | 0 | 0 |

TABLE 7-continued

DHAn-3 and DPAn-6 levels in mature wild type and transgenic
Arabidopsis seed expressing the *Schizochytrium* PUFA synthase along
with Hetl (plastid targeted) in comparison to transgenic seed
combining *Schizochytrium* PUFA synthase along with Hetl (plastid
targeted) combined with expression of *Schizochytrium* ACS-1 and
FAS inhibition, in pooled seeds. The % DHA n-3 and % DPA n-6 were
determined following GC separation and FID detection of total
calculated FAMEs.

| Strategy | Genotype | Line | Generation | Phenotype % DHA (C22:6 n-3) | % DPA (C22:5 n-6) | % DHA + DPA |
|---|---|---|---|---|---|---|
| Positive Control | OrfA, OrfB*, OrfC, Hetl (pooled seed) | 4127- Line 150 | T2 T4 | 0.6 0.6 | 0.7 0.6 | 1.3 1.2 |
| AcylCoAS Expression and FAS inhibition | OrfA, OrfB*, OrfC, Hetl, ACS-1, KAS II RNAi (pooled seed) | 4127/5731- Line 1366 | T4/T2 | 1.9 | 1.9 | 3.8 |

Example 13f

This example describes the production of DHA and DPAn-6 in transgenic *Arabidopsis thaliana* seed expressing the *Schizochytrium* PUFA synthase (OrfA, OrfB* and OrfC) along with Het I, combined with expression of the *Schizochytrium* LPAAT.

Plants derived from 4127-Line 150 were used for the introduction of the LPAAT construct (5725) by *Agrobacterium*-mediated transformation as described above. Following the selection of recombinant plants in the presence of both phosphinothricine and mannose, seeds will be harvested and analyzed for fatty acid profiles by GC separation and FID detection of FAMES prepared from pooled seed.

It is expected that seeds from these plants will produce the target PUFAs (DHA and DPAn-6). It is also expected that the levels of DHA and/or DPAn-6 production will be increased as compared to the PUFA PKS-expressing plant in the absence of the added LPAAT construct.

Example 13g

This example describes the production of DHA and DPAn-6 in transgenic *Arabidopsis thaliana* seed expressing the *Schizochytrium* PUFA synthase (OrfA, OrfB* and OrfC) along with Het I, combined with expression of the *Schizochytrium* DAGAT and ACS-1, and FAS inhibition through the attenuation of KAS II using RNAi or the attenuation of KASIII using antisense.

Plants derived from 5731 (combined expression of ACS-1 and FAS inhibition by KASII RNAi) were used for the introduction of the DAGAT construct (4793) by *Agrobacterium*-mediated transformation as described above. Similar plants were also produced on the 5734 background (combined expression of ACS-1 and FAS inhibition by KASIII antisense). Following the selection of recombinant plants in the presence of both phosphinothricine and mannose, seeds will be harvested and analyzed for fatty acid profiles by GC separation and FID detection of FAMES prepared from pooled seed.

It is expected that seeds from these plants will produce the target PUFAs (DHA and DPAn-6). It is also expected that the levels of DHA and/or DPAn-6 production will be increased as compared to the PUFA PKS-expressing plant in the absence of the added DAGAT construct and FAS inhibition.

Example 13h

This example describes the production of DHA and DPAn-6 in transgenic *Arabidopsis thaliana* seed expressing the *Schizochytrium* PUFA synthase (OrfA, OrfB* and OrfC) along with Het I, combined with expression of the *Schizochytrium* DAGAT and ACS-8, further combined with expression of the *Schizochytrium* ACS-1 and FAS inhibition through the attenuation of KAS II using RNAi or the attenuation of KASIII using antisense.

Plants derived from 5731 (combined expression of ACS-1 and FAS inhibition by KASII RNAi) were used for the introduction of the DAGAT/ACS-8 construct (4794) by *Agrobacterium*-mediated transformation as described above. Similar plants were also produced on the 5734 background (combined expression of ACS-1 and FAS inhibition by KASIII antisense). Following the selection of recombinant plants in the presence of both phosphinothricine and mannose, seeds will be harvested and analyzed for fatty acid profiles by GC separation and FID detection of FAMES prepared from pooled seed.

It is expected that seeds from these plants will produce the target PUFAs (DHA and DPAn-6). It is also expected that the levels of DHA and/or DPAn-6 production will be increased as compared to the PUFA PKS-expressing plant in the absence of the added DAGAT/ACS-8 construct, the ACS-1 construct, and FAS inhibition.

Example 13i

This example describes the production of DHA and DPAn-6 in transgenic *Arabidopsis thaliana* seed expressing the *Schizochytrium* PUFA synthase (OrfA, OrfB* and OrfC) along with Het I, combined with expression of the *Schizochytrium* LPAAT and *Schizochytrium* DAGAT, further combined with expression of the *Schizochytrium* ACS-1 and FAS inhibition through the attenuation of KAS II using RNAi or the attenuation of KASIII using antisense.

Plants derived from 5731 (combined expression of ACS-1 and FAS inhibition by KASII RNAi) were used for the introduction of the DAGAT/LPAAT construct (4795) by *Agrobacterium*-mediated transformation as described above. Similar plants were also produced on the 5734 background (combined expression of ACS-1 and FAS inhibition by KASIII antisense). Following the selection of recombinant plants in the presence of both phosphinothricine and mannose, seeds will be harvested and analyzed for fatty acid profiles by GC separation and FID detection of FAMES prepared from pooled seed.

It is expected that seeds from these plants will produce the target PUFAs (DHA and DPAn-6). It is also expected that the levels of DHA and/or DPAn-6 production will be increased as compared to the PUFA PKS-expressing plant in the absence of the added DAGAT/LPAAT construct, the ACS-1 construct, and FAS inhibition.

Example 13j

This example describes the production of DHA and DPAn-6 in transgenic *Arabidopsis thaliana* seed expressing the *Schizochytrium* PUFA synthase (OrfA, OrfB* and OrfC) along with Het I, combined with expression of the *Schizochytrium* LPAAT, *Schizochytrium* DAGAT, and *Schizochytrium* ACS-8, further combined with expression of the *Schizochytrium* ACS-1 and FAS inhibition through the attenuation of KAS II using RNAi or the attenuation of KASIII using antisense.

Plants derived from 5731 (combined expression of ACS-1 and FAS inhibition by KASII RNAi) were used for the introduction of the DAGAT/LPAAT/ACS-8 construct (4796) by *Agrobacterium*-mediated transformation as described above. Similar plants were also produced on the 5734 background (combined expression of ACS-1 and FAS inhibition by KASIII antisense). Following the selection of recombinant plants in the presence of both phosphinothricine and mannose, seeds will be harvested and analyzed for fatty acid profiles by GC separation and FID detection of FAMES prepared from pooled seed.

It is expected that seeds from these plants will produce the target PUFAs (DHA and DPAn-6). It is also expected that the levels of DHA and/or DPAn-6 production will be increased as compared to the PUFA PKS-expressing plant in the absence of the added DAGAT/LPAAT/ACS-8 construct, the ACS-1 construct, and FAS inhibition.

While various embodiments of the present invention have been described in detail, it is apparent that modifications and adaptations of those embodiments will occur to those skilled in the art. It is to be expressly understood, however, that such modifications and adaptations are within the scope of the present invention.

SEQUENCE LISTING (125 sequences)

SEQ ID NO: 1 - DNA, 8733 bp, Schizochytrium sp.
  CDS (1)..(8733)
atggcggcccgtctgcaggagcaaaagggaggcgagatggatacccgcattgccatcatcggcatgtcggccatcctcccctgcggcacgaccgtgcgcgagtcgtgggagaccatccgcgccggcatcgactgcctgtcggatctccccgaggaccgcgtcgacgtgacggcgtactttgaccccgtcaagaccaccaaggacaagatctactgcaagcgcggtggcttcattcccgagtacgactttgacgcccgcgagttcggactcaacatgttccagatggaggactcggacgcaaaccagaccatctcgcttctcaaggtcaaggaggccctccaggacgccggcatcgacgccctcggcaaggaaaagaagaacatcggctgcgtgctcggcattggcggcggccaaaagtccagccacgagttctactcgcgccttaattatgttgtcgtggagaaggtcctccgcaagatgggcatgcccgaggaggacgtcaaggtcgccgtcgaaaagtacaaggccaacttccccgagtggcgcctcgactccttccctggcttcctcggcaacgtcaccgccggtcgctgcaccaacaccttcaacctcgacggcatgaactgcgttgtcgacgccgcatgcgcctcgtccctcatcgccgtcaaggtcgccatcgacgagctgctctacggtgactgcgacatgatggtcaccggtgccacctgcacggataactccatcggcatgtacatggccttctccaagacccccgtgttctccacggaccccagcgtgcgcgcctacgacgaaaagacaaagggcatgctcatcggcgagggctccgccatgctcgtcctcaagcgctacgccgacgccgtccgcgacggcgatgagatccacgctgttattcgcggctgcgcctcctccagtgatggcaaggccgccggcatctacacgcccaccatttcgggccaggaggaggccctccgccgcgcctacaaccgcgcctgtgtcgacccggccaccgtcactctcgtcgagggtcacggcaccggtactcccgttggcgaccgcatcgagctcaccgccttgcgcaacctctttgacaaggcctacggcgagggcaacaccgaaaaggtcgctgtgggcagcatcaagtccagcatcggccatctcaaggccgtcgccggtctcgccggtatgatcaaggtcatcatggcgctcaagcacaagactctcccgggcaccatcaacgtcgacaacccacccaacctctacgacaacacgcccatcaacgagtcctcgctctacattaacaccatgaaccgcccctggttcccgccccctggtgtgccccgccgcgccggcatttcgagctttggctttggtggcgccaactaccacgccgtcctcgaggaggccgagcccgagcacacgaccgcgtaccgcctcaacaagcgcccgcagcccgtgctcatgatggccgccacgcccgcggccctccagtcgctctgcgaggcccagctcaaggagttcgaggccgccatcaaggagaacgagaccgtcaagaacaccgcctacatcaagtgcgtcaagttcggcgagcagttcaaattccctggctccatcccggccacaaacgcgcgcctcggcttcctcgtcaaggatgctgaggatgcctgctccaccctccgtgccatctgcgcccaattcgccaaggatgtcaccaaggaggcctggcgcctcccccgcgagggcgtcagcttccgcgccaagggcatcgccaccaacggcgctgtcgccgcgctcttctccggccagggcgcgcagtacacgcacatgtttagcgaggtggccatgaactggccccagttccgccagagcattgccgccatggacgccgcccagtccaaggtcgctggaagcgacaaggactttgagcgcgtctcccaggtcctctacccgcgcaagccgtacgagcgtgagcccgagcaggaccacaagaagatctccctcaccgcctactcgcagccctcgaccctggcctgcgctctcggtgcctttgagatcttcaaggaggccggcttcaccccggactttgccgccggccattcgctcggtgagttcgccgccctctacgccgcgggctgcgtcgaccgcgacgagctctttgagcttgtctgccgccgcgcccgcatcatgggcggcaaggacgcaccggccacccccaagggctgcatggccgccgtcattggccccaacgccgagaacatcaaggtccaggccgccaacgtctggctcggcaactccaactcgccttcgcagaccgtcatcaccggctccgtcgaaggtatccaggccgagagcgcccgcctccagaaggagggcttccgcgtcgtgcctcttgcctgcgagagcgccttccactcgccccagatggagaacgcctcgtcggccttcaaggacgtcatctccaaggtctccttccgcacccccaaggccgagaccaagctcttcagcaacgtctctggcgagacctaccccacggacgcccgcgagatgcttacgcagcacatgaccagcagcgtcaagttcctcacccaggtccgcaacatgcaccaggccggtgcgcgcatctttgtcgagttcggacccaagcaggtgctctccaagcttgtctccgagaccctcaaggatgacccctcggttgtcaccgtctctgtcaacccggcctcgggcacggattcggacatccagctccgcgacgcggccgtccagctcgttgtcgctggcgtcaaccttcagggctttgacaagtgggacgcccccgatgccacccgcatgcaggccatcaagaagaagcgcactaccctccgcctttcggccgccacctacgtctcggacaagaccaagaaggtccgcgacgccgccatgaacgatggccgctgcgtcacctacctcaagggcgccgcaccgctcatcaaggccccggagcccgttgtcgacgaggccgccaagcgcgaggccgagcgtctccagaaggagcttcaggatgcccagcgccagctcgacgacgccaagcgcgccgccgccgaggccaactccaagctcgccgctgccaaggaggaggccaagaccgccgctgcttcggccaagcccgcagttgacactgctgttgtcgaaaagcatcgtgccatcctcaagtccatgctcgcggagctcgatggctacggatcggtcgacgcttcttccctccagcagcagcagcagcagcagacggcccccgccccggtcaaggctgctgcgcctgccgcccccgttgcctcggcccctgccccggctgtctcgaacgagcttcttgagaaggccgagactgtcgtcatggaggtcctcgccgccaagaccggctacgagaccgacatgatcgaggctgacatggagctcgagaccgagctcggcattgactccatcaagcgtgtcgagatcctctccgaggtccaggccatgctcaatgtcgaggccaaggatgtcgatgccctcagccgcactcgcactgttggtgaggttgtcaacgccatgaaggccgagatcgctggcagctctgccccggcgcctgctgccgctgctccggctccggccaaggctgcccctgccgccgctgcgcctgctgtctcgaacgagcttctcgagaaggccgagaccgtcgtcatggaggtcctcgccgccaagactggctacgagactgacatgatcgagtccgacatggagctcgagactgagctcggcattgactccatcaagcgtgtcgagatcctctccgaggttcaggccatgctcaacgtcgaggccaaggacgtcgacgctctcagccgcactcgcactgtgggtgaggtcgtcaacgccatgaaggctgagatcgctggtggctctgccccggcgcctgccgccgctgccccaggtccggctgctgccgcccctgcgcctgccgccgccgcccctgctgtctcgaacgagcttcttgagaaggccgagaccgtcgtcatggaggtcctcgccgccaagactggctacgagactgacatgatcgagtccgacatggagctcgagaccgagctcggcattgactccatcaagcgtgtcgagattctctccgaggtccaggccatgctcaacgtcgaggccaaggacgtcgacgctctcagccgcacccgcactgttggcgaggtcgtcgatgccatgaaggccgagatcgctggtggctctgccccggcgcctgccgccgctgctcctgctccggctgctgccgcccctgcgcctgccgcccctgcgcctgctgtctcgagcgagcttctcgagaaggccgagactgtcgtcatggaggtcctcgccgccaagactggctacgagactgacatgatcgagtccgacatggagctcgagaccgagctcggcattgactccatcaagcgtgtcgagattctctccgaggtccaggccatgctcaacgtcgaggccaaggacgtcgacgctctcagccgcacccgcactgttggcgaggtcgtcgatgccatgaaggccgagatcgctggtggctctgccccggcgcctgccgccgctgctcctgctccggctgctgccgcccctgcgcctgccgcccctgcgcctgccgcccctgcgcctgctgtctcgagcgagcttctcgagaaggccgagactgtcgtcatggaggtcctcgccgccaagactggctacgagactgacatgattgagtccgacatggagctcgagaccgagctcggcattgactccatcaagcgtgtcgagattctctccgaggttcaggccatgctcaacgtcgaggccaaggacgtcgacgctctcagccgcactcgcactgttggtgaggtcgtcgatgccatgaaggctgagatcgctggcagctccgcctcggcgcctgccgccgctgctcctgctccggctgctgccgctcctgcgcccgctgccgccgcccctgctgtctcgaacgagcttctcgagaaagccgagactgtcgtcatggaggtcctcgccgccaagactggctacgagactgacatgatcgagtccgacatggagctcgagactgagctcggcattgactccatcaagcgtgtcgagatcctctccgaggttcaggccatgctcaacgtcgaggccaaggacgtcgatgccctcagccgcacccgcactgttggcgaggttgtcgatgccatgaaggccgagatcgctggtggctctgccccggcgcctgccgccgctgcccctgctccggctgccgccgcccctgctgtctcgaacgagcttctcgagaaggccgagactgtcgtcatggaggtcctcgccgccaagactggctacgagaccgacatgatcgagtccgacatggagctcgagaccgagctcggcattgactccatcaagcgtgtcgagattctctccgaggttcaggccatgctcaacgtcgaggccaaggacgtcgatgctctcagccgcactcgcactgttggcgaggtcgtcgatgccatgaaggctgagatcgccggcagctccgccccggcgcctgccgccgctgctcctgctccggctgctgccgctcctgcgcccgctgccgctgcccctgctgtctcgagcgagcttctcgagaaggccgagaccgtcgtcatggaggtcctcgccgccaagactggctacgagactgacatgattgagtccgacatggagctcgagactgagctcggcattgactccatcaagcgtgtcgagatcctctccgaggttcaggccatgctcaacgtcgaggccaaggacgtcgatgccctcagccgcacccgcactgttggcgaggttgtcgatgccatgaaggccgagatcgctggtggctctgccccggcgcctgccgccgctgcccctgctccggctgccgccgcccctgctgtctcgaacgagcttcttgagaaggccgagaccgtcgtcatggaggtcctcgccgccaagactggctacgagaccgacatgatcgagtccgacatggagctcgagaccgagctcggcattgactccatcaagcgtgtcgagattctctccgaggttcaggccatgctcaacgtcgaggccaaggacgtcgacgctctcagccgcactcgcactgttggcgaggtcgtcgatgccatgaaggctgagatcgctggtggctctgccccggcgcctgccgccgctgctcctgcctcggctggcgccgcgcctgcggtcaagattgactcggtccacggcgctgactgtgatgatctttccctgatgcacgccaaggtggttgacatccgccgcccggacgagctcatcctggagcgccccgagaaccgccccgttctcgttgtcgatgacggcagcgagctcaccctcgccctggtccgcgtcctcggcgcctgcgccgttgtcctgacctttgagggtctccagctcgctcagcgcgctggtgccgctgccatccgccacgtgctcgccaaggatctttccgcggagagcgccgagaaggccatcaaggaggccgagcagcgctttggcgctctcggcggcttcatctcgcagcaggcggagcgcttcgagcccgccgaaatcctcggcttcacgctcatgtgcgccaagttcgccaaggcttccctctgcacggctgtggctggcggccgcccggcctttatcggtgtggcgcgccttgacggccgcctcggattcacttcgcagggcacttctgacgcgctcaagcgtgcccagcgtggtgccatctttggcctctgcaagaccatcggcctcgagtggtccgagtctgacgtcttttcccgcggcgtggacattgctcagggcatgcaccccgaggatgccgccgtggcgattgtgcgcgagatggcgtgcgctgacattcgcattcgcgaggtcggcattggcgcaaaccagcagcgctgcacgatccgtgccgccaagctcgagaccggcaacccgcagcgccagatcgccaaggacgacgtgctgctcgtttctggcggcgctcgcggcatcacgcctctttgcatccgggagatcacgcgccagatcgcgggcggcaagtacattctgcttggccgcagcaaggtctctgcgagcgaaccggcatggtgcgctggcatcactgacgagaaggctgtgcaaaaggctgctacccaggagctcaagcgcgcctttagcgctggcgagggccccaagcccacgccccgcgctgtcactaagcttgtgggctctgttcttggcgctcgcgaggtgcgcagctctattgctgcgattgaagcgctcggcggcaaggccatctactcgtcgtgcgacgtgaactctgccgccgacgtggccaaggccgtgcgcgatgccgagtcccagctcggtgcccgcgtctcgggcatcgttcatgcctcgggcgtgctccgcgaccgtctcatcgagaagaagctccccgacgagttcgacgccgtctttggcaccaaggtcaccggtctcgagaacctcctcgccgccgtcgaccgcgccaacctcaagcacatggtcctcttcagctcgctcgccggcttccacggcaacgtcggccagtctgactacgccatggccaacgaggcccttaacaagatgggcctcgagctcgccaaggacgtctcggtcaagtcgatctgcttcggtccctgggacggtggcatggtgacgccgcagctcaagaagcagttccaggagatgggcgtgcagatcatcccccgcgagggcggcgctgataccgtggcgcgcatcgtgctcggctcctcgccggctgagatccttgtcggcaactggcgcaccccgtccaagaaggtcggctcggacaccatcaccctgcaccgcaagatttccgccaagtccaaccccttcctcgaggaccacgtcatccagggccgccgcgtgctgcccatgacgctggccattggctcgctcgcggagacctgcctcggcctcttccccggctactcgctctgggccattgacgacgcccagctcttcaagggtgtcactgtcgacggcgacgtcaactgcgaggtgaccctcaccccgtcgacggcgccctcgggccgcgtcaacgtccaggccacgctcaagaccttttccagcggcaagctggtcccggcctaccgcgccgtcatcgtgctctccaaccagggcgcgcccccggccaacgccaccatgcagccgccctcgctcgatgccgatccggcgctccagggctccgtctacgacggcaagaccctcttccacggcccggccttccgcggcatcgatgacgtgctctcgtgcaccaagagccagcttgtggccaagtgcagcgctgtccccggctccgacgccgctcgcggcgagtttgccacggacactgacgcccatgaccccttcgtgaacgacctggcctttcaggccatgctcgtctgggtgcgccgcacgctcggccaggctgcgctccccaactcgatccagcgcatcgtccagcaccgcccggtcccgcaggacaagcccttctacattaccctccgctccaaccagtcgggcggtcactcccagcacaagcacgcccttcagttccacaacgagcagggcgatctcttcattgatgtccaggcttcggtcatcgccacggacagccttgccttctaa

SEQ ID NO: 2 - protein, 2910 aa, Schizochytrium sp.
MAARLQEQKGGEMDTRIAIIGMSAILPCGTTVRESWETIRAGIDCLSDLPEDRVDVTAYFDPVKTTKDKIYCKRGGFIPEYDFDAREFGLNMFQMEDSDANQTISLLKVKEALQDAGIDALGKEKKNIGCVLGIGGGQKSSHEFYSRLNYVVVEKVLRKMGMPEEDVKVAVEKYKANFPEWRLDSFPGFLGNVTAGRCTNTFNLDGMNCVVDAACASSLIAVKVAIDELLYGDCDMMVTGATCTDNSIGMYMAFSKTPVFSTDPSVRAYDEKTKGMLIGEGSAMLVLKRYADAVRDGDEIHAVIRGCASSSDGKAAGIYTPTISGQEEALRRAYNRACVDPATVTLVEGHGTGTPVGDRIELTALRNLFDKAYGEGNTEKVAVGSIKSSIGHLKAVAGLAGMIKVIMALKHKTLPGTINVDNPPNLYDNTPINESSLYINTMNRPWFPPPGVPRRAGISSFGFGGANYHAVLEEAEPEHTTAYRLNKRPQPVLMMAATPAALQSLCEAQLKEFEAAIKENETVKNTAYIKCVKFGEQFKFPGSIPATNARLGFLVKDAEDACSTLRAICAQFAKDVTKEAWRLPREGVSFRAKGIATNGAVAALFSGQGAQYTHMFSEVAMNWPQFRQSIAAMDAAQSKVAGSDKDFERVSQVLYPRKPYEREPEQDHKKISLTAYSQPSTLACALGAFEIFKEAGFTPDFAAGHSLGEFAALYAAGCVDRDELFELVCRRARIMGGKDAPATPKGCMAAVIGPNAENIKVQAANVWLGNSNSPSQTVITGSVEGIQAESARLQKEGFRVVPLACESAFHSPQMENASSAFKDVISKVSFRTPKAETKLFSNVSGETYPTDAREMLTQHMTSSVKFLTQVRNMHQAGARIFVEFGPKQVLSKLVSETLKDDPSVVTVSVNPASGTDSDIQLRDAAVQLVVAGVNLQGFDKWDAPDATRMQAIKKKRTTLRLSAATYVSDKTKKVRDAAMNDGRCVTYLKGAAPLIKAPEPVVDEAAKREAERLQKELQDAQRQLDDAKRAAAEANSKLAAAKEEAKTAAASAKPAVDTAVVEKHRAILKSMLAELDGYGSVDASSLQQQQQQQTAPAPVKAAAPAAPVASAPAPAVSNELLEKAETVVMEVLAAKTGYETDMIEADMELETELGIDSIKRVEILSEVQAMLNVEAKDVDALSRTRTVGEVVNAMKAEIAGSSAPAPAAAAPAPAKAAPAAAAPAVSNELLEKAETVVMEVLAAKTGYETDMIESDMELETELGIDSIKRVEILSEVQAMLNVEAKDVDALSRTRTVGEVVNAMKAEIAGGSAPAPAAAAPGPAAAAPAPAAAAPAVSNELLEKAETVVMEVLAAKTGYETDMIESDMELETELGIDSIKRVEILSEVQAMLNVEAKDVDALSRTRTVGEVVDAMKAEIAGGSAPAPAAAAPAPAAAAPAPAAPAPAVSSELLEKAETVVMEVLAAKTGYETDMIESDMELETELGIDSIKRVEILSEVQAMLNVEAKDVDALSRTRTVGEVVDAMKAEIAGGSAPAPAAAAPAPAAAAPAPAAPAPAAPAPAVSSELLEKAETVVMEVLAAKTGYETDMIESDMELETELGIDSIKRVEILSEVQAMLNVEAKDVDALSRTRTVGEVVDAMKAEIAGSSASAPAAAAPAPAAAAPAPAAAAPAVSNELLEKAETVVMEVLAAKTGYETDMIESDMELETELGIDSIKRVEILSEVQAMLNVEAKDVDALSRTRTVGEVVDAMKAEIAGGSAPAPAAAAPAPAAAAPAVSNELLEKAETVVMEVLAAKTGYETDMIESDMELETELGIDSIKRVEILSEVQAMLNVEAKDVDALSRTRTVGEVVDAMKAEIAGSSAPAPAAAAPAPAAAAPAPAAAAPAVSSELLEKAETVVMEVLAAKTGYETDMIESDMELETELGIDSIKRVEILSEVQAMLNVEAKDVDALSRTRTVGEVVDAMKAEIAGGSAPAPAAAAPAPAAAAPAVSNELLEKAETVVMEVLAAKTGYETDMIESDMELETELGIDSIKRVEILSEVQAMLNVEAKDVDALSRTRTVGEVVDAMKAEIAGGSAPAPAAAAPASAGAAPAVKIDSVHGADCDDLSLMHAKVVDIRRPDELILERPENRPVLVVDDGSELTLALVRVLGACAVVLTFEGLQLAQRAGAAAIRHVLAKDLSAESAEKAIKEAEQRFGALGGFISQQAERFEPAEILGFTLMCAKFAKASLCTAVAGGRPAFIGVARLDGRLGFTSQGTSDALKRAQRGAIFGLCKTIGLEWSESDVFSRGVDIAQGMHPEDAAVAIVREMACADIRIREVGIGANQQRCTIRAAKLETGNPQRQIAKDDVLLVSGGARGITPLCIREITRQIAGGKYILLGRSKVSASEPAWCAGITDEKAVQKAATQELKRAFSAGEGPKPTPRAVTKLVGSVLGAREVRSSIAAIEALGGKAIYSSCDVNSAADVAKAVRDAESQLGARVSGIVHASGVLRDRLIEKKLPDEFDAVFGTKVTGLENLLAAVDRANLKHMVLFSSLAGFHGNVGQSDYAMANEALNKMGLELAKDVSVKSICFGPWDGGMVTPQLKKQFQEMGVQIIPREGGADTVARIVLGSSPAEILVGNWRTPSKKVGSDTITLHRKISAKSNPFLEDHVIQGRRVLPMTLAIGSLAETCLGLFPGYSLWAIDDAQLFKGVTVDGDVNCEVTLTPSTAPSGRVNVQATLKTFSSGKLVPAYRAVIVLSNQGAPPANATMQPPSLDADPALQGSVYDGKTLFHGPAFRGIDDVLSCTKSQLVAKCSAVPGSDAARGEFATDTDAHDPFVNDLAFQAMLVWVRRTLGQAALPNSIQRIVQHRPVPQDKPFYITLRSNQSGGHSQHKHALQFHNEQGDLFIDVQASVIATDSLAF

SEQ ID NO: 3 - DNA, 6180 bp, Schizochytrium sp.
  CDS (1)..(6180)
atggccgctcggaatgtgagcgccgcgcatgagatgcacgatgaaaagcgcatcgccgtcgtcggcatggccgtccagtacgccggatgcaaaaccaaggacgagttctgggaggtgctcatgaacggcaaggtcgagtccaaggtgatcagcgacaaacgactcggctccaactaccgcgccgagcactacaaagcagagcgcagcaagtatgccgacaccttttgcaacgaaacgtacggcacccttgacgagaacgagatcgacaacgagcacgaactcctcctcaacctcgccaagcaggcactcgcagagacatccgtcaaagactcgacacgctgcggcatcgtcagcggctgcctctcgttccccatggacaacctccagggtgaactcctcaacgtgtaccaaaaccatgtcgagaaaaagctcggggcccgcgtcttcaaggacgcctcccattggtccgaacgcgagcagtccaacaaacccgaggccggtgaccgccgcatcttcatggacccggcctccttcgtcgccgaagaactcaacctcggcgcccttcactactccgtcgacgcagcatgcgccacggcgctctacgtgctccgcctcgcgcaggatcatctcgtctccggcgccgccgacgtcatgctctgcggtgccacctgcctgccggagccctttttcatcctttcgggcttttccaccttccaggccatgcccgtcggcacgggccagaacgtgtccatgccgctgcacaaggacagccagggcctcaccccgggtgagggcggctccatcatggtcctcaagcgtctcgatgatgccatccgcgacggcgaccacatctacggcacccttctcggcgccaatgtcagcaactccggcacaggtctgcccctcaagccccttctccccagcgagaaaaagtgcctcatggacacctacacgcgcattaacgtgcacccgcacaagattcagtacgtcgagtgccacgccaccggcacgccccagggtgatcgtgtggaaatcgacgccgtcaaggcctgctttgaaggcaaggtcccccgtttcggtaccacaaagggcaactttggacacaccctcgtcgcagccggctttgccggtatgtgcaaggtcctcctctccatgaagcatggcatcatcccgcccaccccgggtatcgatgacgagaccaagatggaccctctcgtcgtctccggtgaggccatcccatggccagagaccaacggcgagcccaagcgcgccggtctctcggcctttggctttggtggcaccaacgcccatgccgtctttgaggagcatgacccctccaacgccgcctgcacgggccacgactccatttctgcgctctcggcccgctgcggcggtgaaagcaacatgcgcatcgccatcactggtatggacgccacctttggcgctctcaagggactcgacgccttcgagcgcgccatttacaccggcgctcacggtgccatcccactcccagaaaagcgctggcgctttctcggcaaggacaaggactttcttgacctctgcggcgtcaaggccaccccgcacggctgctacattgaagatgttgaggtcgacttccagcgcctccgcacgcccatgacccctgaagacatgctcctccctcagcagcttctggccgtcaccaccattgaccgcgccatcctcgactcgggaatgaaaaagggtggcaatgtcgccgtctttgtcggcctcggcaccgacctcgagctctaccgtcaccgtgctcgcgtcgctctcaaggagcgcgtccgccctgaagcctccaagaagctcaatgacatgatgcagtacattaacgactgcggcacatccacatcgtacacctcgtacattggcaacctcgtcgccacgcgcgtctcgtcgcagtggggcttcacgggcccctcctttacgatcaccgagggcaacaactccgtctaccgctgcgccgagctcggcaagtacctcctcgagaccggcgaggtcgatggcgtcgtcgttgcgggtgtcgatctctgcggcagtgccgaaaacctttacgtcaagtctcgccgcttcaaggtgtccacctccgataccccgcgcgccagctttgacgccgccgccgatggctactttgtcggcgagggctgcggtgcctttgtgctcaagcgtgagactagctgcaccaaggacgaccgtatctacgcttgcatggatgccatcgtccctggcaacgtccctagcgcctgcttgcgcgaggccctcgaccaggcgcgcgtcaagccgggcgatatcgagatgctcgagctcagcgccgactccgcccgccacctcaaggacccgtccgtcctgcccaaggagctcactgccgaggaggaaatcggcggccttcagacgatccttcgtgacgatgacaagctcccgcgcaacgtcgcaacgggcagtgtcaaggccaccgtcggtgacaccggttatgcctctggtgctgccagcctcatcaaggctgcgctttgcatctacaaccgctacctgcccagcaacggcgacgactgggatgaacccgcccctgaggcgccctgggacagcaccctctttgcgtgccagacctcgcgcgcttggctcaagaaccctggcgagcgtcgctatgcggccgtctcgggcgtctccgagacgcgctcgtgctattccgtgctcctctccgaagccgagggccactacgagcgcgagaaccgcatctcgctcgacgaggaggcgcccaagctcattgtgcttcgcgccgactcccacgaggagatccttggtcgcctcgacaagatccgcgagcgcttcttgcagcccacgggcgccgccccgcgcgagtccgagctcaaggcgcaggcccgccgcatcttcctcgagctcctcggcgagacccttgcccaggatgccgcttcttcaggctcgcaaaagcccctcgctctcagcctcgtctccacgccctccaagctccagcgcgaggtcgagctcgcggccaagggtatcccgcgctgcctcaagatgcgccgcgattggagctcccctgctggcagccgctacgcgcctgagccgctcgccagcgaccgcgtcgccttcatgtacggcgaaggtcgcagcccttactacggcatcacccaagacattcaccgcatttggcccgaactccacgaggtcatcaacgaaaagacgaaccgtctctgggccgaaggcgaccgctgggtcatgccgcgcgccagcttcaagtcggagctcgagagccagcagcaagagtttgatcgcaacatgattgaaatgttccgtcttggaatcctcacctcaattgccttcaccaatctggcgcgcgacgttctcaacatcacgcccaaggccgcctttggcctcagtcttggcgagatttccatgatttttgccttttccaagaagaacggtctcatctccgaccagctcaccaaggatcttcgcgagtccgacgtgtggaacaaggctctggccgttgaatttaatgcgctgcgcgaggcctggggcattccacagagtgtccccaaggacgagttctggcaaggctacattgtgcgcggcaccaagcaggatatcgaggcggccatcgccccggacagcaagtacgtgcgcctcaccatcatcaatgatgccaacaccgccctcattagcggcaagcccgacgcctgcaaggctgcgatcgcgcgtctcggtggcaacattcctgcgcttcccgtgacccagggcatgtgcggccactgccccgaggtgggaccttataccaaggatatcgccaagatccatgccaaccttgagttccccgttgtcgacggccttgacctctggaccacaatcaaccagaagcgcctcgtgccacgcgccacgggcgccaaggacgaatgggccccttcttcctttggcgagtacgccggccagctctacgagaagcaggctaacttcccccaaatcgtcgagaccatttacaagcaaaactacgacgtctttgtcgaggttgggcccaacaaccaccgtagcaccgcagtgcgcaccacgcttggtccccagcgcaaccaccttgctggcgccatcgacaagcagaacgaggatgcttggacgaccatcgtcaagcttgtggcttcgctcaaggcccaccttgttcctggcgtcacgatctcgccgctgtaccactccaagcttgtggcggaggctgaggcttgctacgctgcgctctgcaagggtgaaaagcccaagaagaacaagtttgtgcgcaagattcagctcaacggtcgcttcaacagcaaggcggaccccatctcctcggccgatcttgccagctttccgcctgcggaccctgccattgaagccgccatctcgagccgcatcatgaagcctgtcgctcccaagttctacgcgcgtctcaacattgacgagcaggacgagacccgagatccgatcctcaacaaggacaacgcgccgtcttcttcttcttcttcttcttcttcttcttcttcttcttcttctccgtcgcctgctccttcggcccccgtgcaaaagaaggctgctcccgccgcggagaccaaggctgttgcttcggctgacgcacttcgcagtgccctgctcgatctcgacagtatgcttgcgctgagctctgccagtgcctccggcaaccttgttgagactgcgcctagcgacgcctcggtcattgtgccgccctgcaacattgcggatctcggcagccgcgccttcatgaaaacgtacggtgtttcggcgcctctgtacacgggcgccatggccaagggcattgcctctgcggacctcgtcattgccgccggccgccagggcatccttgcgtcctttggcgccggcggacttcccatgcaggttgtgcgtgagtccatcgaaaagattcaggccgccctgcccaatggcccgtacgctgtcaaccttatccattctccctttgacagcaacctcgaaaagggcaatgtcgatctcttcctcgagaagggtgtcacctttgtcgaggcctcggcctttatgacgctcaccccgcaggtcgtgcggtaccgcgcggctggcctcacgcgcaacgccgacggctcggtcaacatccgcaaccgtatcattggcaaggtctcgcgcaccgagctcgccgagatgttcatgcgtcctgcgcccgagcaccttcttcagaagctcattgcttccggcgagatcaaccaggagcaggccgagctcgcccgccgtgttcccgtcgctgacgacatcgcggtcgaagctgactcgggtggccacaccgacaaccgccccatccacgtcattctgcccctcatcatcaaccttcgcgaccgccttcaccgcgagtgcggctacccggccaaccttcgcgtccgtgtgggcgccggcggtggcattgggtgcccccaggcggcgctggccaccttcaacatgggtgcctcctttattgtcaccggcaccgtgaaccaggtcgccaagcagtcgggcacgtgcgacaatgtgcgcaagcagctcgcgaaggccacttactcggacgtatgcatggccccggctgccgacatgttcgaggaaggcgtcaagcttcaggtcctcaagaagggaaccatgtttccctcgcgcgccaacaagctctacgagctcttttgcaagtacgactcgttcgagtccatgccccccgcagagcttgcgcgcgtcgagaagcgcatcttcagccgcgcgctcgaagaggtctgggacgagaccaaaaacttttacattaaccgtcttcacaacccggagaagatccagcgcgccgagcgcgaccccaagctcaagatgtcgctgtgctttcgctggtacctgagcctggcgagccgctgggccaacactggagcttccgatcgcgtcatggactaccaggtctggtgcggtcctgccattggttccttcaacgatttcatcaagggaacttaccttgatccggccgtcgcaaacgagtacccgtgcgtcgttcagattaacaagcagatccttcgtggagcgtgcttcttgcgccgtctcgaaattctgcgcaacgcacgcctttccgatggcgctgccgctcttgtggccagcatcgatgacacatacgtcccggccgagaagctgtaa

SEQ ID NO: 4 - protein, 2059 aa, Schizochytrium sp.
MAARNVSAAHEMHDEKRIAVVGMAVQYAGCKTKDEFWEVLMNGKVESKVISDKRLGSNYRAEHYKAERSKYADTFCNETYGTLDENEIDNEHELLLNLAKQALAETSVKDSTRCGIVSGCLSFPMDNLQGELLNVYQNHVEKKLGARVFKDASHWSEREQSNKPEAGDRRIFMDPASFVAEELNLGALHYSVDAACATALYVLRLAQDHLVSGAADVMLCGATCLPEPFFILSGFSTFQAMPVGTGQNVSMPLHKDSQGLTPGEGGSIMVLKRLDDAIRDGDHIYGTLLGANVSNSGTGLPLKPLLPSEKKCLMDTYTRINVHPHKIQYVECHATGTPQGDRVEIDAVKACFEGKVPRFGTTKGNFGHTLVAAGFAGMCKVLLSMKHGIIPPTPGIDDETKMDPLVVSGEAIPWPETNGEPKRAGLSAFGFGGTNAHAVFEEHDPSNAACTGHDSISALSARCGGESNMRIAITGMDATFGALKGLDAFERAIYTGAHGAIPLPEKRWRFLGKDKDFLDLCGVKATPHGCYIEDVEVDFQRLRTPMTPEDMLLPQQLLAVTTIDRAILDSGMKKGGNVAVFVGLGTDLELYRHRARVALKERVRPEASKKLNDMMQYINDCGTSTSYTSYIGNLVATRVSSQWGFTGPSFTITEGNNSVYRCAELGKYLLETGEVDGVVVAGVDLCGSAENLYVKSRRFKVSTSDTPRASFDAAADGYFVGEGCGAFVLKRETSCTKDDRIYACMDAIVPGNVPSACLREALDQARVKPGDIEMLELSADSARHLKDPSVLPKELTAEEEIGGLQTILRDDDKLPRNVATGSVKATVGDTGYASGAASLIKAALCIYNRYLPSNGDDWDEPAPEAPWDSTLFACQTSRAWLKNPGERRYAAVSGVSETRSCYSVLLSEAEGHYERENRISLDEEAPKLIVLRADSHEEILGRLDKIRERFLQPTGAAPRESELKAQARRIFLELLGETLAQDAASSGSQKPLALSLVSTPSKLQREVELAAKGIPRCLKMRRDWSSPAGSRYAPEPLASDRVAFMYGEGRSPYYGITQDIHRIWPELHEVINEKTNRLWAEGDRWVMPRASFKSELESQQQEFDRNMIEMFRLGILTSIAFTNLARDVLNITPKAAFGLSLGEISMIFAFSKKNGLISDQLTKDLRESDVWNKALAVEFNALREAWGIPQSVPKDEFWQGYIVRGTKQDIEAAIAPDSKYVRLTIINDANTALISGKPDACKAAIARLGGNIPALPVTQGMCGHCPEVGPYTKDIAKIHANLEFPVVDGLDLWTTINQKRLVPRATGAKDEWAPSSFGEYAGQLYEKQANFPQIVETIYKQNYDVFVEVGPNNHRSTAVRTTLGPQRNHLAGAIDKQNEDAWTTIVKLVASLKAHLVPGVTISPLYHSKLVAEAEACYAALCKGEKPKKNKFVRKIQLNGRFNSKADPISSADLASFPPADPAIEAAISSRIMKPVAPKFYARLNIDEQDETRDPILNKDNAPSSSSSSSSSSSSSSSPSPAPSAPVQKKAAPAAETKAVASADALRSALLDLDSMLALSSASASGNLVETAPSDASVIVPPCNIADLGSRAFMKTYGVSAPLYTGAMAKGIASADLVIAAGRQGILASFGAGGLPMQVVRESIEKIQAALPNGPYAVNLIHSPFDSNLEKGNVDLFLEKGVTFVEASAFMTLTPQVVRYRAAGLTRNADGSVNIRNRIIGKVSRTELAEMFMRPAPEHLLQKLIASGEINQEQAELARRVPVADDIAVEADSGGHTDNRPIHVILPLIINLRDRLHRECGYPANLRVRVGAGGGIGCPQAALATFNMGASFIVTGTVNQVAKQSGTCDNVRKQLAKATYSDVCMAPAADMFEEGVKLQVLKKGTMFPSRANKLYELFCKYDSFESMPPAELARVEKRIFSRALEEVWDETKNFYINRLHNPEKIQRAERDPKLKMSLCFRWYLSLASRWANTGASDRVMDYQVWCGPAIGSFNDFIKGTYLDPAVANEYPCVVQINKQILRGACFLRRLEILRNARLSDGAAALVASIDDTYVPAEKL

SEQ ID NO: 5 - DNA, 4509 bp, Schizochytrium sp.
  CDS (1)..(4509)
atggcgctccgtgtcaagacgaacaagaagccatgctgggagatgaccaaggaggagctgaccagcggcaagaccgaggtgttcaactatgaggaactcctcgagttcgcagagggcgacatcgccaaggtcttcggacccgagttcgccgtcatcgacaagtacccgcgccgcgtgcgcctgcccgcccgcgagtacctgctcgtgacccgcgtcaccctcatggacgccgaggtcaacaactaccgcgtcggcgcccgcatggtcaccgagtacgatctccccgtcaacggagagctctccgagggcggagactgcccctgggccgtcctggtcgagagtggccagtgcgatctcatgctcatctcctacatgggcattgacttccagaaccagggcgaccgcgtctaccgcctgctcaacaccacgctcaccttttacggcgtggcccacgagggcgagaccctcgagtacgacattcgcgtcaccggcttcgccaagcgtctcgacggcggcatctccatgttcttcttcgagtacgactgctacgtcaacggccgcctcctcatcgagatgcgcgatggctgcgccggcttcttcaccaacgaggagctcgacgccggcaagggcgtcgtcttcacccgcggcgacctcgccgcccgcgccaagatcccaaagcaggacgtctccccctacgccgtcgccccctgcctccacaagaccaagctcaacgaaaaggagatgcagaccctcgtcgacaaggactgggcatccgtctttggctccaagaacggcatgccggaaatcaactacaaactctgcgcgcgtaagatgctcatgattgaccgcgtcaccagcattgaccacaagggcggtgtctacggcctcggtcagctcgtcggtgaaaagatcctcgagcgcgaccactggtactttccctgccactttgtcaaggatcaggtcatggccggatccctcgtctccgacggctgcagccagatgctcaagatgtacatgatctggctcggcctccacctcaccaccggaccctttgacttccgcccggtcaacggccaccccaacaaggtccgctgccgcggccaaatctccccgcacaagggcaagctcgtctacgtcatggagatcaaggagatgggcttcgacgaggacaacgacccgtacgccattgccgacgtcaacatcattgatgtcgacttcgaaaagggccaggactttagcctcgaccgcatcagcgactacggcaagggcgacctcaacaagaagatcgtcgtcgactttaagggcatcgctctcaagatgcagaagcgctccaccaacaagaacccctccaaggttcagcccgtctttgccaacggcgccgccactgtcggccccgaggcctccaaggcttcctccggcgccagcgccagcgccagcgccgccccggccaagcctgccttcagcgccgatgttcttgcgcccaagcccgttgcccttcccgagcacatcctcaagggcgacgccctcgcccccaaggagatgtcctggcaccccatggcccgcatcccgggcaacccgacgccctcttttgcgccctcggcctacaagccgcgcaacatcgcctttacgcccttccccggcaaccccaacgataacgaccacaccccgggcaagatgccgctcacctggttcaacatggccgagttcatggccggcaaggtcagcatgtgcctcggccccgagttcgccaagttcgacgactcgaacaccagccgcagccccgcttgggacctcgctctcgtcacccgcgccgtgtctgtgtctgacctcaagcacgtcaactaccgcaacatcgacctcgacccctccaagggtaccatggtcggcgagttcgactgccccgcggacgcctggttctacaagggcgcctgcaacgatgcccacatgccgtactcgatcctcatggagatcgccctccagacctcgggtgtgctcacctcggtgctcaaggcgcccctgaccatggagaaggacgacatcctcttccgcaacctcgacgccaacgccgagttcgtgcgcgccgacctcgactaccgcggcaagactatccgcaacgtcaccaagtgcactggctacagcatgctcggcgagatgggcgtccaccgcttcacctttgagctctacgtcgatgatgtgctcttttacaagggctcgacctcgttcggctggttcgtgcccgaggtctttgccgcccaggccggcctcgacaacggccgcaagtcggagccctggttcattgagaacaaggttccggcctcgcaggtctcctcctttgacgtgcgccccaacggcagcggccgcaccgccatcttcgccaacgcccccagcggcgcccagctcaaccgccgcacggaccagggccagtacctcgacgccgtcgacattgtctccggcagcggcaagaagagcctcggctacgcccacggttccaagacggtcaacccgaacgactggttcttctcgtgccacttttggtttgactcggtcatgcccggaagtctcggtgtcgagtccatgttccagctcgtcgaggccatcgccgcccacgaggatctcgctggcaagcacggcattgccaaccccacctttgtgcacgccccgggcaagatcagctggaagtaccgcggccagctcacgcccaagagcaagaagatggactcggaggtccacatcgtgtccgtggacgcccacgacggcgttgtcgacctcgtcgccgacggcttcctctgggccgacagcctccgcgtctactcggtgagcaacattcgcgtgcgcatcgcctccggtgaggcccctgccgccgcctcctccgccgcctctgtgggctcctcggcttcgtccgtcgagcgcacgcgctcgagccccgctgtcgcctccggcccggcccagaccatcgacctcaagcagctcaagaccgagctcctcgagctcgatgccccgctctacctctcgcaggacccgaccagcggccagctcaagaagcacaccgacgtggcctccggccaggccaccatcgtgcagccctgcacgctcggcgacctcggtgaccgctccttcatggagacctacggcgtcgtcgccccgctgtacacgggcgccatggccaagggcattgcctcggcggacctcgtcatcgccgccggcaagcgcaagatcctcggctcctttggcgccggcggcctccccatgcaccacgtgcgcgccgccctcgagaagatccaggccgccctgcctcagggcccctacgccgtcaacctcatccactcgccttttgacagcaacctcgagaagggcaacgtcgatctcttcctcgagaagggcgtcactgtggtggaggcctcggcattcatgaccctcaccccgcaggtcgtgcgctaccgcgccgccggcctctcgcgcaacgccgacggttcggtcaacatccgcaaccgcatcatcggcaaggtctcgcgcaccgagctcgccgagatgttcatccgcccggccccggagcacctcctcgagaagctcatcgcctcgggcgagatcacccaggagcaggccgagctcgcgcgccgcgttcccgtcgccgacgatatcgctgtcgaggctgactcgggcggccacaccgacaaccgccccatccacgtcatcctcccgctcatcatcaacctccgcaaccgcctgcaccgcgagtgcggctaccccgcgcacctccgcgtccgcgttggcgccggcggtggcgtcggctgcccgcaggccgccgccgccgcgctcaccatgggcgccgccttcatcgtcaccggcactgtcaaccaggtcgccaagcagtccggcacctgcgacaacgtgcgcaagcagctctcgcaggccacctactcggatatctgcatggccccggccgccgacatgttcgaggagggcgtcaagctccaggtcctcaagaagggaaccatgttcccctcgcgcgccaacaagctctacgagctcttttgcaagtacgactccttcgactccatgcctcctgccgagctcgagcgcatcgagaagcgtatcttcaagcgcgcactccaggaggtctgggaggagaccaaggacttttacattaacggtctcaagaacccggagaagatccagcgcgccgagcacgaccccaagctcaagatgtcgctctgcttccgctggtaccttggtcttgccagccgctgggccaacatgggcgccccggaccgcgtcatggactaccaggtctggtgtggcccggccattggcgccttcaacgacttcatcaagggcacctacctcgaccccgctgtctccaacgagtacccctgtgtcgtccagatcaacctgcaaatcctccgtggtgcctgctacctgcgccgtctcaacgccctgcgcaacgacccgcgcattgacctcgagaccgaggatgctgcctttgtctacgagcccaccaacgcgctctaa

SEQ ID NO: 6 - protein, 1502 aa, Schizochytrium sp.
MALRVKTNKKPCWEMTKEELTSGKTEVFNYEELLEFAEGDIAKVFGPEFAVIDKYPRRVRLPAREYLLVTRVTLMDAEVNNYRVGARMVTEYDLPVNGELSEGGDCPWAVLVESGQCDLMLISYMGIDFQNQGDRVYRLLNTTLTFYGVAHEGETLEYDIRVTGFAKRLDGGISMFFFEYDCYVNGRLLIEMRDGCAGFFTNEELDAGKGVVFTRGDLAARAKIPKQDVSPYAVAPCLHKTKLNEKEMQTLVDKDWASVFGSKNGMPEINYKLCARKMLMIDRVTSIDHKGGVYGLGQLVGEKILERDHWYFPCHFVKDQVMAGSLVSDGCSQMLKMYMIWLGLHLTTGPFDFRPVNGHPNKVRCRGQISPHKGKLVYVMEIKEMGFDEDNDPYAIADVNIIDVDFEKGQDFSLDRISDYGKGDLNKKIVVDFKGIALKMQKRSTNKNPSKVQPVFANGAATVGPEASKASSGASASASAAPAKPAFSADVLAPKPVALPEHILKGDALAPKEMSWHPMARIPGNPTPSFAPSAYKPRNIAFTPFPGNPNDNDHTPGKMPLTWFNMAEFMAGKVSMCLGPEFAKFDDSNTSRSPAWDLALVTRAVSVSDLKHVNYRNIDLDPSKGTMVGEFDCPADAWFYKGACNDAHMPYSILMEIALQTSGVLTSVLKAPLTMEKDDILFRNLDANAEFVRADLDYRGKTIRNVTKCTGYSMLGEMGVHRFTFELYVDDVLFYKGSTSFGWFVPEVFAAQAGLDNGRKSEPWFIENKVPASQVSSFDVRPNGSGRTAIFANAPSGAQLNRRTDQGQYLDAVDIVSGSGKKSLGYAHGSKTVNPNDWFFSCHFWFDSVMPGSLGVESMFQLVEAIAAHEDLAGKHGIANPTFVHAPGKISWKYRGQLTPKSKKMDSEVHIVSVDAHDGVVDLVADGFLWADSLRVYSVSNIRVRIASGEAPAAASSAASVGSSASSVERTRSSPAVASGPAQTIDLKQLKTELLELDAPLYLSQDPTSGQLKKHTDVASGQATIVQPCTLGDLGDRSFMETYGVVAPLYTGAMAKGIASADLVIAAGKRKILGSFGAGGLPMHHVRAALEKIQAALPQGPYAVNLIHSPFDSNLEKGNVDLFLEKGVTVVEASAFMTLTPQVVRYRAAGLSRNADGSVNIRNRIIGKVSRTELAEMFIRPAPEHLLEKLIASGEITQEQAELARRVPVADDIAVEADSGGHTDNRPIHVILPLIINLRNRLHRECGYPAHLRVRVGAGGGVGCPQAAAAALTMGAAFIVTGTVNQVAKQSGTCDNVRKQLSQATYSDICMAPAADMFEEGVKLQVLKKGTMFPSRANKLYELFCKYDSFDSMPPAELERIEKRIFKRALQEVWEETKDFYINGLKNPEKIQRAEHDPKLKMSLCFRWYLGLASRWANMGAPDRVMDYQVWCGPAIGAFNDFIKGTYLDPAVSNEYPCVVQINLQILRGACYLRRLNALRNDPRIDLETEDAAFVYEPTNAL

SEQ ID NO: 7 - DNA, 1500 bp, Schizochytrium sp.
  CDS (1)..(1500)
atggcggcccgtctgcaggagcaaaagggaggcgagatggatacccgcattgccatcatcggcatgtcggccatcctcccctgcggcacgaccgtgcgcgagtcgtgggagaccatccgcgccggcatcgactgcctgtcggatctccccgaggaccgcgtcgacgtgacggcgtactttgaccccgtcaagaccaccaaggacaagatctactgcaagcgcggtggcttcattcccgagtacgactttgacgcccgcgagttcggactcaacatgttccagatggaggactcggacgcaaaccagaccatctcgcttctcaaggtcaaggaggccctccaggacgccggcatcgacgccctcggcaaggaaaagaagaacatcggctgcgtgctcggcattggcggcggccaaaagtccagccacgagttctactcgcgccttaattatgttgtcgtggagaaggtcctccgcaagatgggcatgcccgaggaggacgtcaaggtcgccgtcgaaaagtacaaggccaacttccccgagtggcgcctcgactccttccctggcttcctcggcaacgtcaccgccggtcgctgcaccaacaccttcaacctcgacggcatgaactgcgttgtcgacgccgcatgcgcctcgtccctcatcgccgtcaaggtcgccatcgacgagctgctctacggtgactgcgacatgatggtcaccggtgccacctgcacggataactccatcggcatgtacatggccttctccaagacccccgtgttctccacggaccccagcgtgcgcgcctacgacgaaaagacaaagggcatgctcatcggcgagggctccgccatgctcgtcctcaagcgctacgccgacgccgtccgcgacggcgatgagatccacgctgttattcgcggctgcgcctcctccagtgatggcaaggccgccggcatctacacgcccaccatttcgggccaggaggaggccctccgccgcgcctacaaccgcgcctgtgtcgacccggccaccgtcactctcgtcgagggtcacggcaccggtactcccgttggcgaccgcatcgagctcaccgccttgcgcaacctctttgacaaggcctacggcgagggcaacaccgaaaaggtcgctgtgggcagcatcaagtccagcatcggccatctcaaggccgtcgccggtctcgccggtatgatcaaggtcatcatggcgctcaagcacaagactctcccgggcaccatcaacgtcgacaacccacccaacctctacgacaacacgcccatcaacgagtcctcgctctacattaacaccatgaaccgcccctggttcccgccccctggtgtgccccgccgcgccggcatttcgagctttggctttggtggcgccaactaccacgccgtcctcgaggaggccgagcccgagcacacgaccgcgtaccgcctcaacaagcgcccgcagcccgtgctcatgatggccgccacgcccgcg

SEQ ID NO: 8 - protein, 500 aa, Schizochytrium sp.
MAARLQEQKGGEMDTRIAIIGMSAILPCGTTVRESWETIRAGIDCLSDLPEDRVDVTAYFDPVKTTKDKIYCKRGGFIPEYDFDAREFGLNMFQMEDSDANQTISLLKVKEALQDAGIDALGKEKKNIGCVLGIGGGQKSSHEFYSRLNYVVVEKVLRKMGMPEEDVKVAVEKYKANFPEWRLDSFPGFLGNVTAGRCTNTFNLDGMNCVVDAACASSLIAVKVAIDELLYGDCDMMVTGATCTDNSIGMYMAFSKTPVFSTDPSVRAYDEKTKGMLIGEGSAMLVLKRYADAVRDGDEIHAVIRGCASSSDGKAAGIYTPTISGQEEALRRAYNRACVDPATVTLVEGHGTGTPVGDRIELTALRNLFDKAYGEGNTEKVAVGSIKSSIGHLKAVAGLAGMIKVIMALKHKTLPGTINVDNPPNLYDNTPINESSLYINTMNRPWFPPPGVPRRAGISSFGFGGANYHAVLEEAEPEHTTAYRLNKRPQPVLMMAATPA

SEQ ID NO: 9 - DNA, 1278 bp, Schizochytrium sp.
  CDS (1)..(1278)
gatgtcaccaaggaggcctggcgcctcccccgcgagggcgtcagcttccgcgccaagggcatcgccaccaacggcgctgtcgccgcgctcttctccggccagggcgcgcagtacacgcacatgtttagcgaggtggccatgaactggccccagttccgccagagcattgccgccatggacgccgcccagtccaaggtcgctggaagcgacaaggactttgagcgcgtctcccaggtcctctacccgcgcaagccgtacgagcgtgagcccgagcaggaccacaagaagatctccctcaccgcctactcgcagccctcgaccctggcctgcgctctcggtgcctttgagatcttcaaggaggccggcttcaccccggactttgccgccggccattcgctcggtgagttcgccgccctctacgccgcgggctgcgtcgaccgcgacgagctctttgagcttgtctgccgccgcgcccgcatcatgggcggcaaggacgcaccggccacccccaagggctgcatggccgccgtcattggccccaacgccgagaacatcaaggtccaggccgccaacgtctggctcggcaactccaactcgccttcgcagaccgtcatcaccggctccgtcgaaggtatccaggccgagagcgcccgcctccagaaggagggcttccgcgtcgtgcctcttgcctgcgagagcgccttccactcgccccagatggagaacgcctcgtcggccttcaaggacgtcatctccaaggtctccttccgcacccccaaggccgagaccaagctcttcagcaacgtctctggcgagacctaccccacggacgcccgcgagatgcttacgcagcacatgaccagcagcgtcaagttcctcacccaggtccgcaacatgcaccaggccggtgcgcgcatctttgtcgagttcggacccaagcaggtgctctccaagcttgtctccgagaccctcaaggatgacccctcggttgtcaccgtctctgtcaacccggcctcgggcacggattcggacatccagctccgcgacgcggccgtccagctcgttgtcgctggcgtcaaccttcagggctttgacaagtgggacgcccccgatgccacccgcatgcaggccatcaagaagaagcgcactaccctccgcctttcggccgccacctacgtctcggacaagaccaagaaggtccgcgacgccgccatgaacgatggccgctgcgtcacctacctcaagggcgccgcaccgctcatcaaggccccggagccc

SEQ ID NO: 10 - protein, 426 aa, Schizochytrium sp.
DVTKEAWRLPREGVSFRAKGIATNGAVAALFSGQGAQYTHMFSEVAMNWPQFRQSIAAMDAAQSKVAGSDKDFERVSQVLYPRKPYEREPEQDHKKISLTAYSQPSTLACALGAFEIFKEAGFTPDFAAGHSLGEFAALYAAGCVDRDELFELVCRRARIMGGKDAPATPKGCMAAVIGPNAENIKVQAANVWLGNSNSPSQTVITGSVEGIQAESARLQKEGFRVVPLACESAFHSPQMENASSAFKDVISKVSFRTPKAETKLFSNVSGETYPTDAREMLTQHMTSSVKFLTQVRNMHQAGARIFVEFGPKQVLSKLVSETLKDDPSVVTVSVNPASGTDSDIQLRDAAVQLVVAGVNLQGFDKWDAPDATRMQAIKKKRTTLRLSAATYVSDKTKKVRDAAMNDGRCVTYLKGAAPLIKAPEP

SEQ ID NO: 11 - protein, 5 aa, Schizochytrium sp.
  MISC_FEATURE (4)..(4): X = any amino acid
GHSXG

SEQ ID NO: 12 - DNA, 258 bp, Schizochytrium sp.
  CDS (1)..(258)
gctgtctcgaacgagcttcttgagaaggccgagactgtcgtcatggaggtcctcgccgccaagaccggctacgagaccgacatgatcgaggctgacatggagctcgagaccgagctcggcattgactccatcaagcgtgtcgagatcctctccgaggtccaggccatgctcaatgtcgaggccaaggatgtcgatgccctcagccgcactcgcactgttggtgaggttgtcaacgccatgaaggccgagatcgctggc

SEQ ID NO: 13 - protein, 86 aa, Schizochytrium sp.
AVSNELLEKAETVVMEVLAAKTGYETDMIEADMELETELGIDSIKRVEILSEVQAMLNVEAKDVDALSRTRTVGEVVNAMKAEIAG

SEQ ID NO: 14 - protein, 5 aa, Schizochytrium sp.
LGIDS

SEQ ID NO: 15 - protein, 21 aa, Schizochytrium sp.
APAPVKAAAPAAPVASAPAPA

SEQ ID NO: 16 - DNA, 3006 bp, Schizochytrium sp.
gcccccgccccggtcaaggctgctgcgcctgccgcccccgttgcctcggcccctgccccggctgtctcgaacgagcttcttgagaaggccgagactgtcgtcatggaggtcctcgccgccaagaccggctacgagaccgacatgatcgaggctgacatggagctcgagaccgagctcggcattgactccatcaagcgtgtcgagatcctctccgaggtccaggccatgctcaatgtcgaggccaaggatgtcgatgccctcagccgcactcgcactgttggtgaggttgtcaacgccatgaaggccgagatcgctggcagctctgccccggcgcctgctgccgctgctccggctccggccaaggctgcccctgccgccgctgcgcctgctgtctcgaacgagcttctcgagaaggccgagaccgtcgtcatggaggtcctcgccgccaagactggctacgagactgacatgatcgagtccgacatggagctcgagactgagctcggcattgactccatcaagcgtgtcgagatcctctccgaggttcaggccatgctcaacgtcgaggccaaggacgtcgacgctctcagccgcactcgcactgtgggtgaggtcgtcaacgccatgaaggctgagatcgctggtggctctgccccggcgcctgccgccgctgccccaggtccggctgctgccgcccctgcgcctgccgccgccgcccctgctgtctcgaacgagcttcttgagaaggccgagaccgtcgtcatggaggtcctcgccgccaagactggctacgagactgacatgatcgagtccgacatggagctcgagaccgagctcggcattgactccatcaagcgtgtcgagattctctccgaggtccaggccatgctcaacgtcgaggccaaggacgtcgacgctctcagccgcacccgcactgttggcgaggtcgtcgatgccatgaaggccgagatcgctggtggctctgccccggcgcctgccgccgctgctcctgctccggctgctgccgcccctgcgcctgccgcccctgcgcctgctgtctcgagcgagcttctcgagaaggccgagactgtcgtcatggaggtcctcgccgccaagactggctacgagactgacatgatcgagtccgacatggagctcgagaccgagctcggcattgactccatcaagcgtgtcgagattctctccgaggtccaggccatgctcaacgtcgaggccaaggacgtcgacgctctcagccgcacccgcactgttggcgaggtcgtcgatgccatgaaggccgagatcgctggtggctctgccccggcgcctgccgccgctgctcctgctccggctgctgccgcccctgcgcctgccgcccctgcgcctgccgcccctgcgcctgctgtctcgagcgagcttctcgagaaggccgagactgtcgtcatggaggtcctcgccgccaagactggctacgagactgacatgattgagtccgacatggagctcgagaccgagctcggcattgactccatcaagcgtgtcgagattctctccgaggttcaggccatgctcaacgtcgaggccaaggacgtcgacgctctcagccgcactcgcactgttggtgaggtcgtcgatgccatgaaggctgagatcgctggcagctccgcctcggcgcctgccgccgctgctcctgctccggctgctgccgctcctgcgcccgctgccgccgcccctgctgtctcgaacgagcttctcgagaaagccgagactgtcgtcatggaggtcctcgccgccaagactggctacgagactgacatgatcgagtccgacatggagctcgagactgagctcggcattgactccatcaagcgtgtcgagatcctctccgaggttcaggccatgctcaacgtcgaggccaaggacgtcgatgccctcagccgcacccgcactgttggcgaggttgtcgatgccatgaaggccgagatcgctggtggctctgccccggcgcctgccgccgctgcccctgctccggctgccgccgcccctgctgtctcgaacgagcttctcgagaaggccgagactgtcgtcatggaggtcctcgccgccaagactggctacgagaccgacatgatcgagtccgacatggagctcgagaccgagctcggcattgactccatcaagcgtgtcgagattctctccgaggttcaggccatgctcaacgtcgaggccaaggacgtcgatgctctcagccgcactcgcactgttggcgaggtcgtcgatgccatgaaggctgagatcgccggcagctccgccccggcgcctgccgccgctgctcctgctccggctgctgccgctcctgcgcccgctgccgctgcccctgctgtctcgagcgagcttctcgagaaggccgagaccgtcgtcatggaggtcctcgccgccaagactggctacgagactgacatgattgagtccgacatggagctcgagactgagctcggcattgactccatcaagcgtgtcgagatcctctccgaggttcaggccatgctcaacgtcgaggccaaggacgtcgatgccctcagccgcacccgcactgttggcgaggttgtcgatgccatgaaggccgagatcgctggtggctctgccccggcgcctgccgccgctgcccctgctccggctgccgccgcccctgctgtctcgaacgagcttcttgagaaggccgagaccgtcgtcatggaggtcctcgccgccaagactggctacgagaccgacatgatcgagtccgacatggagctcgagaccgagctcggcattgactccatcaagcgtgtcgagattctctccgaggttcaggccatgctcaacgtcgaggccaaggacgtcgacgctctcagccgcactcgcactgttggcgaggtcgtcgatgccatgaaggctgagatcgctggtggctctgccccggcgcctgccgccgctgctcctgcctcggctggcgccgcgcctgcg

SEQ ID NO: 17 - DNA, 2133 bp, Schizochytrium sp.
  CDS (1)..(2133)
tttggcgctctcggcggcttcatctcgcagcaggcggagcgcttcgagcccgccgaaatcctcggcttcacgctcatgtgcgccaagttcgccaaggcttccctctgcacggctgtggctggcggccgcccggcctttatcggtgtggcgcgccttgacggccgcctcggattcacttcgcagggcacttctgacgcgctcaagcgtgcccagcgtggtgccatctttggcctctgcaagaccatcggcctcgagtggtccgagtctgacgtcttttcccgcggcgtggacattgctcagggcatgcaccccgaggatgccgccgtggcgattgtgcgcgagatggcgtgcgctgacattcgcattcgcgaggtcggcattggcgcaaaccagcagcgctgcacgatccgtgccgccaagctcgagaccggcaacccgcagcgccagatcgccaaggacgacgtgctgctcgtttctggcggcgctcgcggcatcacgcctctttgcatccgggagatcacgcgccagatcgcgggcggcaagtacattctgcttggccgcagcaaggtctctgcgagcgaaccggcatggtgcgctggcatcactgacgagaaggctgtgcaaaaggctgctacccaggagctcaagcgcgcctttagcgctggcgagggccccaagcccacgccccgcgctgtcactaagcttgtgggctctgttcttggcgctcgcgaggtgcgcagctctattgctgcgattgaagcgctcggcggcaaggccatctactcgtcgtgcgacgtgaactctgccgccgacgtggccaaggccgtgcgcgatgccgagtcccagctcggtgcccgcgtctcgggcatcgttcatgcctcgggcgtgctccgcgaccgtctcatcgagaagaagctccccgacgagttcgacgccgtctttggcaccaaggtcaccggtctcgagaacctcctcgccgccgtcgaccgcgccaacctcaagcacatggtcctcttcagctcgctcgccggcttccacggcaacgtcggccagtctgactacgccatggccaacgaggcccttaacaagatgggcctcgagctcgccaaggacgtctcggtcaagtcgatctgcttcggtccctgggacggtggcatggtgacgccgcagctcaagaagcagttccaggagatgggcgtgcagatcatcccccgcgagggcggcgctgataccgtggcgcgcatcgtgctcggctcctcgccggctgagatccttgtcggcaactggcgcaccccgtccaagaaggtcggctcggacaccatcaccctgcaccgcaagatttccgccaagtccaaccccttcctcgaggaccacgtcatccagggccgccgcgtgctgcccatgacgctggccattggctcgctcgcggagacctgcctcggcctcttccccggctactcgctctgggccattgacgacgcccagctcttcaagggtgtcactgtcgacggcgacgtcaactgcgaggtgaccctcaccccgtcgacggcgccctcgggccgcgtcaacgtccaggccacgctcaagaccttttccagcggcaagctggtcccggcctaccgcgccgtcatcgtgctctccaaccagggcgcgcccccggccaacgccaccatgcagccgccctcgctcgatgccgatccggcgctccagggctccgtctacgacggcaagaccctcttccacggcccggccttccgcggcatcgatgacgtgctctcgtgcaccaagagccagcttgtggccaagtgcagcgctgtccccggctccgacgccgctcgcggcgagtttgccacggacactgacgcccatgaccccttcgtgaacgacctggcctttcaggccatgctcgtctgggtgcgccgcacgctcggccaggctgcgctccccaactcgatccagcgcatcgtccagcaccgcccggtcccgcaggacaagcccttctacattaccctccgctccaaccagtcgggcggtcactcccagcacaagcacgcccttcagttccacaacgagcagggcgatctcttcattgatgtccaggcttcggtcatcgccacggacagccttgccttc

SEQ ID NO: 18 - protein, 711 aa, Schizochytrium sp.
FGALGGFISQQAERFEPAEILGFTLMCAKFAKASLCTAVAGGRPAFIGVARLDGRLGFTSQGTSDALKRAQRGAIFGLCKTIGLEWSESDVFSRGVDIAQGMHPEDAAVAIVREMACADIRIREVGIGANQQRCTIRAAKLETGNPQRQIAKDDVLLVSGGARGITPLCIREITRQIAGGKYILLGRSKVSASEPAWCAGITDEKAVQKAATQELKRAFSAGEGPKPTPRAVTKLVGSVLGAREVRSSIAAIEALGGKAIYSSCDVNSAADVAKAVRDAESQLGARVSGIVHASGVLRDRLIEKKLPDEFDAVFGTKVTGLENLLAAVDRANLKHMVLFSSLAGFHGNVGQSDYAMANEALNKMGLELAKDVSVKSICFGPWDGGMVTPQLKKQFQEMGVQIIPREGGADTVARIVLGSSPAEILVGNWRTPSKKVGSDTITLHRKISAKSNPFLEDHVIQGRRVLPMTLAIGSLAETCLGLFPGYSLWAIDDAQLFKGVTVDGDVNCEVTLTPSTAPSGRVNVQATLKTFSSGKLVPAYRAVIVLSNQGAPPANATMQPPSLDADPALQGSVYDGKTLFHGPAFRGIDDVLSCTKSQLVAKCSAVPGSDAARGEFATDTDAHDPFVNDLAFQAMLVWVRRTLGQAALPNSIQRIVQHRPVPQDKPFYITLRSNQSGGHSQHKHALQFHNEQGDLFIDVQASVIATDSLAF

SEQ ID NO: 19 - DNA, 1350 bp, Schizochytrium sp.
  CDS (1)..(1350)
atggccgctcggaatgtgagcgccgcgcatgagatgcacgatgaaaagcgcatcgccgtcgtcggcatggccgtccagtacgccggatgcaaaaccaaggacgagttctgggaggtgctcatgaacggcaaggtcgagtccaaggtgatcagcgacaaacgactcggctccaactaccgcgccgagcactacaaagcagagcgcagcaagtatgccgacaccttttgcaacgaaacgtacggcacccttgacgagaacgagatcgacaacgagcacgaactcctcctcaacctcgccaagcaggcactcgcagagacatccgtcaaagactcgacacgctgcggcatcgtcagcggctgcctctcgttccccatggacaacctccagggtgaactcctcaacgtgtaccaaaaccatgtcgagaaaaagctcggggcccgcgtcttcaaggacgcctcccattggtccgaacgcgagcagtccaacaaacccgaggccggtgaccgccgcatcttcatggacccggcctccttcgtcgccgaagaactcaacctcggcgcccttcactactccgtcgacgcagcatgcgccacggcgctctacgtgctccgcctcgcgcaggatcatctcgtctccggcgccgccgacgtcatgctctgcggtgccacctgcctgccggagccctttttcatcctttcgggcttttccaccttccaggccatgcccgtcggcacgggccagaacgtgtccatgccgctgcacaaggacagccagggcctcaccccgggtgagggcggctccatcatggtcctcaagcgtctcgatgatgccatccgcgacggcgaccacatctacggcacccttctcggcgccaatgtcagcaactccggcacaggtctgcccctcaagccccttctccccagcgagaaaaagtgcctcatggacacctacacgcgcattaacgtgcacccgcacaagattcagtacgtcgagtgccacgccaccggcacgccccagggtgatcgtgtggaaatcgacgccgtcaaggcctgctttgaaggcaaggtcccccgtttcggtaccacaaagggcaactttggacacaccctcgtcgcagccggctttgccggtatgtgcaaggtcctcctctccatgaagcatggcatcatcccgcccaccccgggtatcgatgacgagaccaagatggaccctctcgtcgtctccggtgaggccatcccatggccagagaccaacggcgagcccaagcgcgccggtctctcggcctttggctttggtggcaccaacgcccatgccgtctttgaggagcatgacccctccaacgccgcctgc

SEQ ID NO: 20 - protein, 450 aa, Schizochytrium sp.
MAARNVSAAHEMHDEKRIAVVGMAVQYAGCKTKDEFWEVLMNGKVESKVISDKRLGSNYRAEHYKAERSKYADTFCNETYGTLDENEIDNEHELLLNLAKQALAETSVKDSTRCGIVSGCLSFPMDNLQGELLNVYQNHVEKKLGARVFKDASHWSEREQSNKPEAGDRRIFMDPASFVAEELNLGALHYSVDAACATALYVLRLAQDHLVSGAADVMLCGATCLPEPFFILSGFSTFQAMPVGTGQNVSMPLHKDSQGLTPGEGGSIMVLKRLDDAIRDGDHIYGTLLGANVSNSGTGLPLKPLLPSEKKCLMDTYTRINVHPHKIQYVECHATGTPQGDRVEIDAVKACFEGKVPRFGTTKGNFGHTLVAAGFAGMCKVLLSMKHGIIPPTPGIDDETKMDPLVVSGEAIPWPETNGEPKRAGLSAFGFGGTNAHAVFEEHDPSNAAC

SEQ ID NO: 21 - DNA, 1323 bp, Schizochytrium sp.
  CDS (1)..(1323)
tcggcccgctgcggcggtgaaagcaacatgcgcatcgccatcactggtatggacgccacctttggcgctctcaagggactcgacgccttcgagcgcgccatttacaccggcgctcacggtgccatcccactcccagaaaagcgctggcgctttctcggcaaggacaaggactttcttgacctctgcggcgtcaaggccaccccgcacggctgctacattgaagatgttgaggtcgacttccagcgcctccgcacgcccatgacccctgaagacatgctcctccctcagcagcttctggccgtcaccaccattgaccgcgccatcctcgactcgggaatgaaaaagggtggcaatgtcgccgtctttgtcggcctcggcaccgacctcgagctctaccgtcaccgtgctcgcgtcgctctcaaggagcgcgtccgccctgaagcctccaagaagctcaatgacatgatgcagtacattaacgactgcggcacatccacatcgtacacctcgtacattggcaacctcgtcgccacgcgcgtctcgtcgcagtggggcttcacgggcccctcctttacgatcaccgagggcaacaactccgtctaccgctgcgccgagctcggcaagtacctcctcgagaccggcgaggtcgatggcgtcgtcgttgcgggtgtcgatctctgcggcagtgccgaaaacctttacgtcaagtctcgccgcttcaaggtgtccacctccgataccccgcgcgccagctttgacgccgccgccgatggctactttgtcggcgagggctgcggtgcctttgtgctcaagcgtgagactagctgcaccaaggacgaccgtatctacgcttgcatggatgccatcgtccctggcaacgtccctagcgcctgcttgcgcgaggccctcgaccaggcgcgcgtcaagccgggcgatatcgagatgctcgagctcagcgccgactccgcccgccacctcaaggacccgtccgtcctgcccaaggagctcactgccgaggaggaaatcggcggccttcagacgatccttcgtgacgatgacaagctcccgcgcaacgtcgcaacgggcagtgtcaaggccaccgtcggtgacaccggttatgcctctggtgctgccagcctcatcaaggctgcgctttgcatctacaaccgctacctgcccagcaacggcgacgactgggatgaacccgcccctgaggcgccctgggacagcaccctctttgcgtgccagacctcgcgcgcttggctcaagaaccctggcgagcgtcgctatgcggccgtctcgggcgtctccgagacgcgctcg

SEQ ID NO: 22 - protein, 441 aa, Schizochytrium sp.
SARCGGESNMRIAITGMDATFGALKGLDAFERAIYTGAHGAIPLPEKRWRFLGKDKDFLDLCGVKATPHGCYIEDVEVDFQRLRTPMTPEDMLLPQQLLAVTTIDRAILDSGMKKGGNVAVFVGLGTDLELYRHRARVALKERVRPEASKKLNDMMQYINDCGTSTSYTSYIGNLVATRVSSQWGFTGPSFTITEGNNSVYRCAELGKYLLETGEVDGVVVAGVDLCGSAENLYVKSRRFKVSTSDTPRASFDAAADGYFVGEGCGAFVLKRETSCTKDDRIYACMDAIVPGNVPSACLREALDQARVKPGDIEMLELSADSARHLKDPSVLPKELTAEEEIGGLQTILRDDDKLPRNVATGSVKATVGDTGYASGAASLIKAALCIYNRYLPSNGDDWDEPAPEAPWDSTLFACQTSRAWLKNPGERRYAAVSGVSETRS

SEQ ID NO: 23 - DNA, 1500 bp, Schizochytrium sp.
  CDS (1)..(1500)
tgctattccgtgctcctctccgaagccgagggccactacgagcgcgagaaccgcatctcgctcgacgaggaggcgcccaagctcattgtgcttcgcgccgactcccacgaggagatccttggtcgcctcgacaagatccgcgagcgcttcttgcagcccacgggcgccgccccgcgcgagtccgagctcaaggcgcaggcccgccgcatcttcctcgagctcctcggcgagacccttgcccaggatgccgcttcttcaggctcgcaaaagcccctcgctctcagcctcgtctccacgccctccaagctccagcgcgaggtcgagctcgcggccaagggtatcccgcgctgcctcaagatgcgccgcgattggagctcccctgctggcagccgctacgcgcctgagccgctcgccagcgaccgcgtcgccttcatgtacggcgaaggtcgcagcccttactacggcatcacccaagacattcaccgcatttggcccgaactccacgaggtcatcaacgaaaagacgaaccgtctctgggccgaaggcgaccgctgggtcatgccgcgcgccagcttcaagtcggagctcgagagccagcagcaagagtttgatcgcaacatgattgaaatgttccgtcttggaatcctcacctcaattgccttcaccaatctggcgcgcgacgttctcaacatcacgcccaaggccgcctttggcctcagtcttggcgagatttccatgatttttgccttttccaagaagaacggtctcatctccgaccagctcaccaaggatcttcgcgagtccgacgtgtggaacaaggctctggccgttgaatttaatgcgctgcgcgaggcctggggcattccacagagtgtccccaaggacgagttctggcaaggctacattgtgcgcggcaccaagcaggatatcgaggcggccatcgccccggacagcaagtacgtgcgcctcaccatcatcaatgatgccaacaccgccctcattagcggcaagcccgacgcctgcaaggctgcgatcgcgcgtctcggtggcaacattcctgcgcttcccgtgacccagggcatgtgcggccactgccccgaggtgggaccttataccaaggatatcgccaagatccatgccaaccttgagttccccgttgtcgacggccttgacctctggaccacaatcaaccagaagcgcctcgtgccacgcgccacgggcgccaaggacgaatgggccccttcttcctttggcgagtacgccggccagctctacgagaagcaggctaacttcccccaaatcgtcgagaccatttacaagcaaaactacgacgtctttgtcgaggttgggcccaacaaccaccgtagcaccgcagtgcgcaccacgcttggtccccagcgcaaccaccttgctggcgccatcgacaagcagaacgaggatgcttggacgaccatcgtcaagcttgtggcttcgctcaaggcccaccttgttcctggcgtc

SEQ ID NO: 24 - protein, 500 aa, Schizochytrium sp.
CYSVLLSEAEGHYERENRISLDEEAPKLIVLRADSHEEILGRLDKIRERFLQPTGAAPRESELKAQARRIFLELLGETLAQDAASSGSQKPLALSLVSTPSKLQREVELAAKGIPRCLKMRRDWSSPAGSRYAPEPLASDRVAFMYGEGRSPYYGITQDIHRIWPELHEVINEKTNRLWAEGDRWVMPRASFKSELESQQQEFDRNMIEMFRLGILTSIAFTNLARDVLNITPKAAFGLSLGEISMIFAFSKKNGLISDQLTKDLRESDVWNKALAVEFNALREAWGIPQSVPKDEFWQGYIVRGTKQDIEAAIAPDSKYVRLTIINDANTALISGKPDACKAAIARLGGNIPALPVTQGMCGHCPEVGPYTKDIAKIHANLEFPVVDGLDLWTTINQKRLVPRATGAKDEWAPSSFGEYAGQLYEKQANFPQIVETIYKQNYDVFVEVGPNNHRSTAVRTTLGPQRNHLAGAIDKQNEDAWTTIVKLVASLKAHLVPGV

SEQ ID NO: 25 - DNA, 1530 bp, Schizochytrium sp.
  CDS (1)..(1530)
ctgctcgatctcgacagtatgcttgcgctgagctctgccagtgcctccggcaaccttgttgagactgcgcctagcgacgcctcggtcattgtgccgccctgcaacattgcggatctcggcagccgcgccttcatgaaaacgtacggtgtttcggcgcctctgtacacgggcgccatggccaagggcattgcctctgcggacctcgtcattgccgccggccgccagggcatccttgcgtcctttggcgccggcggacttcccatgcaggttgtgcgtgagtccatcgaaaagattcaggccgccctgcccaatggcccgtacgctgtcaaccttatccattctccctttgacagcaacctcgaaaagggcaatgtcgatctcttcctcgagaagggtgtcacctttgtcgaggcctcggcctttatgacgctcaccccgcaggtcgtgcggtaccgcgcggctggcctcacgcgcaacgccgacggctcggtcaacatccgcaaccgtatcattggcaaggtctcgcgcaccgagctcgccgagatgttcatgcgtcctgcgcccgagcaccttcttcagaagctcattgcttccggcgagatcaaccaggagcaggccgagctcgcccgccgtgttcccgtcgctgacgacatcgcggtcgaagctgactcgggtggccacaccgacaaccgccccatccacgtcattctgcccctcatcatcaaccttcgcgaccgccttcaccgcgagtgcggctacccggccaaccttcgcgtccgtgtgggcgccggcggtggcattgggtgcccccaggcggcgctggccaccttcaacatgggtgcctcctttattgtcaccggcaccgtgaaccaggtcgccaagcagtcgggcacgtgcgacaatgtgcgcaagcagctcgcgaaggccacttactcggacgtatgcatggccccggctgccgacatgttcgaggaaggcgtcaagcttcaggtcctcaagaagggaaccatgtttccctcgcgcgccaacaagctctacgagctcttttgcaagtacgactcgttcgagtccatgccccccgcagagcttgcgcgcgtcgagaagcgcatcttcagccgcgcgctcgaagaggtctgggacgagaccaaaaacttttacattaaccgtcttcacaacccggagaagatccagcgcgccgagcgcgaccccaagctcaagatgtcgctgtgctttcgctggtacctgagcctggcgagccgctgggccaacactggagcttccgatcgcgtcatggactaccaggtctggtgcggtcctgccattggttccttcaacgatttcatcaagggaacttaccttgatccggccgtcgcaaacgagtacccgtgcgtcgttcagattaacaagcagatccttcgtggagcgtgcttcttgcgccgtctcgaaattctgcgcaacgcacgcctttccgatggcgctgccgctcttgtggccagcatcgatgacacatacgtcccggccgagaagctg

SEQ ID NO: 26 - protein, 510 aa, Schizochytrium sp.
LLDLDSMLALSSASASGNLVETAPSDASVIVPPCNIADLGSRAFMKTYGVSAPLYTGAMAKGIASADLVIAAGRQGILASFGAGGLPMQVVRESIEKIQAALPNGPYAVNLIHSPFDSNLEKGNVDLFLEKGVTFVEASAFMTLTPQVVRYRAAGLTRNADGSVNIRNRIIGKVSRTELAEMFMRPAPEHLLQKLIASGEINQEQAELARRVPVADDIAVEADSGGHTDNRPIHVILPLIINLRDRLHRECGYPANLRVRVGAGGGIGCPQAALATFNMGASFIVTGTVNQVAKQSGTCDNVRKQLAKATYSDVCMAPAADMFEEGVKLQVLKKGTMFPSRANKLYELFCKYDSFESMPPAELARVEKRIFSRALEEVWDETKNFYINRLHNPEKIQRAERDPKLKMSLCFRWYLSLASRWANTGASDRVMDYQVWCGPAIGSFNDFIKGTYLDPAVANEYPCVVQINKQILRGACFLRRLEILRNARLSDGAAALVASIDDTYVPAEKL

SEQ ID NO: 27 - DNA, 1350 bp, Schizochytrium sp.
  CDS (1)..(1350)
atggcgctccgtgtcaagacgaacaagaagccatgctgggagatgaccaaggaggagctgaccagcggcaagaccgaggtgttcaactatgaggaactcctcgagttcgcagagggcgacatcgccaaggtcttcggacccgagttcgccgtcatcgacaagtacccgcgccgcgtgcgcctgcccgcccgcgagtacctgctcgtgacccgcgtcaccctcatggacgccgaggtcaacaactaccgcgtcggcgcccgcatggtcaccgagtacgatctccccgtcaacggagagctctccgagggcggagactgcccctgggccgtcctggtcgagagtggccagtgcgatctcatgctcatctcctacatgggcattgacttccagaaccagggcgaccgcgtctaccgcctgctcaacaccacgctcaccttttacggcgtggcccacgagggcgagaccctcgagtacgacattcgcgtcaccggcttcgccaagcgtctcgacggcggcatctccatgttcttcttcgagtacgactgctacgtcaacggccgcctcctcatcgagatgcgcgatggctgcgccggcttcttcaccaacgaggagctcgacgccggcaagggcgtcgtcttcacccgcggcgacctcgccgcccgcgccaagatcccaaagcaggacgtctccccctacgccgtcgccccctgcctccacaagaccaagctcaacgaaaaggagatgcagaccctcgtcgacaaggactgggcatccgtctttggctccaagaacggcatgccggaaatcaactacaaactctgcgcgcgtaagatgctcatgattgaccgcgtcaccagcattgaccacaagggcggtgtctacggcctcggtcagctcgtcggtgaaaagatcctcgagcgcgaccactggtactttccctgccactttgtcaaggatcaggtcatggccggatccctcgtctccgacggctgcagccagatgctcaagatgtacatgatctggctcggcctccacctcaccaccggaccctttgacttccgcccggtcaacggccaccccaacaaggtccgctgccgcggccaaatctccccgcacaagggcaagctcgtctacgtcatggagatcaaggagatgggcttcgacgaggacaacgacccgtacgccattgccgacgtcaacatcattgatgtcgacttcgaaaagggccaggactttagcctcgaccgcatcagcgactacggcaagggcgacctcaacaagaagatcgtcgtcgactttaagggcatcgctctcaagatgcagaagcgctccaccaacaagaacccctcc

SEQ ID NO: 28 - protein, 450 aa, Schizochytrium sp.
MALRVKTNKKPCWEMTKEELTSGKTEVFNYEELLEFAEGDIAKVFGPEFAVIDKYPRRVRLPAREYLLVTRVTLMDAEVNNYRVGARMVTEYDLPVNGELSEGGDCPWAVLVESGQCDLMLISYMGIDFQNQGDRVYRLLNTTLTFYGVAHEGETLEYDIRVTGFAKRLDGGISMFFFEYDCYVNGRLLIEMRDGCAGFFTNEELDAGKGVVFTRGDLAARAKIPKQDVSPYAVAPCLHKTKLNEKEMQTLVDKDWASVFGSKNGMPEINYKLCARKMLMIDRVTSIDHKGGVYGLGQLVGEKILERDHWYFPCHFVKDQVMAGSLVSDGCSQMLKMYMIWLGLHLTTGPFDFRPVNGHPNKVRCRGQISPHKGKLVYVMEIKEMGFDEDNDPYAIADVNIIDVDFEKGQDFSLDRISDYGKGDLNKKIVVDFKGIALKMQKRSTNKNPS

SEQ ID NO: 29 - DNA, 1497 bp, Schizochytrium sp.
  CDS (1)..(1497)
aaggttcagcccgtctttgccaacggcgccgccactgtcggccccgaggcctccaaggcttcctccggcgccagcgccagcgccagcgccgccccggccaagcctgccttcagcgccgatgttcttgcgcccaagcccgttgcccttcccgagcacatcctcaagggcgacgccctcgcccccaaggagatgtcctggcaccccatggcccgcatcccgggcaacccgacgccctcttttgcgccctcggcctacaagccgcgcaacatcgcctttacgcccttccccggcaaccccaacgataacgaccacaccccgggcaagatgccgctcacctggttcaacatggccgagttcatggccggcaaggtcagcatgtgcctcggccccgagttcgccaagttcgacgactcgaacaccagccgcagccccgcttgggacctcgctctcgtcacccgcgccgtgtctgtgtctgacctcaagcacgtcaactaccgcaacatcgacctcgacccctccaagggtaccatggtcggcgagttcgactgccccgcggacgcctggttctacaagggcgcctgcaacgatgcccacatgccgtactcgatcctcatggagatcgccctccagacctcgggtgtgctcacctcggtgctcaaggcgcccctgaccatggagaaggacgacatcctcttccgcaacctcgacgccaacgccgagttcgtgcgcgccgacctcgactaccgcggcaagactatccgcaacgtcaccaagtgcactggctacagcatgctcggcgagatgggcgtccaccgcttcacctttgagctctacgtcgatgatgtgctcttttacaagggctcgacctcgttcggctggttcgtgcccgaggtctttgccgcccaggccggcctcgacaacggccgcaagtcggagccctggttcattgagaacaaggttccggcctcgcaggtctcctcctttgacgtgcgccccaacggcagcggccgcaccgccatcttcgccaacgcccccagcggcgcccagctcaaccgccgcacggaccagggccagtacctcgacgccgtcgacattgtctccggcagcggcaagaagagcctcggctacgcccacggttccaagacggtcaacccgaacgactggttcttctcgtgccacttttggtttgactcggtcatgcccggaagtctcggtgtcgagtccatgttccagctcgtcgaggccatcgccgcccacgaggatctcgctggcaagcacggcattgccaaccccacctttgtgcacgccccgggcaagatcagctggaagtaccgcggccagctcacgcccaagagcaagaagatggactcggaggtccacatcgtgtccgtggacgcccacgacggcgttgtcgacctcgtcgccgacggcttcctctgggccgacagcctccgcgtctactcggtgagcaacattcgcgtgcgcatcgcctccggt

SEQ ID NO: 30 - protein, 499 aa, Schizochytrium sp.
KVQPVFANGAATVGPEASKASSGASASASAAPAKPAFSADVLAPKPVALPEHILKGDALAPKEMSWHPMARIPGNPTPSFAPSAYKPRNIAFTPFPGNPNDNDHTPGKMPLTWFNMAEFMAGKVSMCLGPEFAKFDDSNTSRSPAWDLALVTRAVSVSDLKHVNYRNIDLDPSKGTMVGEFDCPADAWFYKGACNDAHMPYSILMEIALQTSGVLTSVLKAPLTMEKDDILFRNLDANAEFVRADLDYRGKTIRNVTKCTGYSMLGEMGVHRFTFELYVDDVLFYKGSTSFGWFVPEVFAAQAGLDNGRKSEPWFIENKVPASQVSSFDVRPNGSGRTAIFANAPSGAQLNRRTDQGQYLDAVDIVSGSGKKSLGYAHGSKTVNPNDWFFSCHFWFDSVMPGSLGVESMFQLVEAIAAHEDLAGKHGIANPTFVHAPGKISWKYRGQLTPKSKKMDSEVHIVSVDAHDGVVDLVADGFLWADSLRVYSVSNIRVRIASG

SEQ ID NO: 31 - DNA, 1512 bp, Schizochytrium sp.
  CDS (1)..(1512)
gccccgctctacctctcgcaggacccgaccagcggccagctcaagaagcacaccgacgtggcctccggccaggccaccatcgtgcagccctgcacgctcggcgacctcggtgaccgctccttcatggagacctacggcgtcgtcgccccgctgtacacgggcgccatggccaagggcattgcctcggcggacctcgtcatcgccgccggcaagcgcaagatcctcggctcctttggcgccggcggcctccccatgcaccacgtgcgcgccgccctcgagaagatccaggccgccctgcctcagggcccctacgccgtcaacctcatccactcgccttttgacagcaacctcgagaagggcaacgtcgatctcttcctcgagaagggcgtcactgtggtggaggcctcggcattcatgaccctcaccccgcaggtcgtgcgctaccgcgccgccggcctctcgcgcaacgccgacggttcggtcaacatccgcaaccgcatcatcggcaaggtctcgcgcaccgagctcgccgagatgttcatccgcccggccccggagcacctcctcgagaagctcatcgcctcgggcgagatcacccaggagcaggccgagctcgcgcgccgcgttcccgtcgccgacgatatcgctgtcgaggctgactcgggcggccacaccgacaaccgccccatccacgtcatcctcccgctcatcatcaacctccgcaaccgcctgcaccgcgagtgcggctaccccgcgcacctccgcgtccgcgttggcgccggcggtggcgtcggctgcccgcaggccgccgccgccgcgctcaccatgggcgccgccttcatcgtcaccggcactgtcaaccaggtcgccaagcagtccggcacctgcgacaacgtgcgcaagcagctctcgcaggccacctactcggatatctgcatggccccggccgccgacatgttcgaggagggcgtcaagctccaggtcctcaagaagggaaccatgttcccctcgcgcgccaacaagctctacgagctcttttgcaagtacgactccttcgactccatgcctcctgccgagctcgagcgcatcgagaagcgtatcttcaagcgcgcactccaggaggtctgggaggagaccaaggacttttacattaacggtctcaagaacccggagaagatccagcgcgccgagcacgaccccaagctcaagatgtcgctctgcttccgctggtaccttggtcttgccagccgctgggccaacatgggcgccccggaccgcgtcatggactaccaggtctggtgtggcccggccattggcgccttcaacgacttcatcaagggcacctacctcgaccccgctgtctccaacgagtacccctgtgtcgtccagatcaacctgcaaatcctccgtggtgcctgctacctgcgccgtctcaacgccctgcgcaacgacccgcgcattgacctcgagaccgaggatgctgcctttgtctacgagcccaccaacgcgctc

SEQ ID NO: 32 - protein, 504 aa, Schizochytrium sp.
APLYLSQDPTSGQLKKHTDVASGQATIVQPCTLGDLGDRSFMETYGVVAPLYTGAMAKGIASADLVIAAGKRKILGSFGAGGLPMHHVRAALEKIQAALPQGPYAVNLIHSPFDSNLEKGNVDLFLEKGVTVVEASAFMTLTPQVVRYRAAGLSRNADGSVNIRNRIIGKVSRTELAEMFIRPAPEHLLEKLIASGEITQEQAELARRVPVADDIAVEADSGGHTDNRPIHVILPLIINLRNRLHRECGYPAHLRVRVGAGGGVGCPQAAAAALTMGAAFIVTGTVNQVAKQSGTCDNVRKQLSQATYSDICMAPAADMFEEGVKLQVLKKGTMFPSRANKLYELFCKYDSFDSMPPAELERIEKRIFKRALQEVWEETKDFYINGLKNPEKIQRAEHDPKLKMSLCFRWYLGLASRWANMGAPDRVMDYQVWCGPAIGAFNDFIKGTYLDPAVSNEYPCVVQINLQILRGACYLRRLNALRNDPRIDLETEDAAFVYEPTNAL

SEQ ID NO: 33 - DNA, 714 bp, Nostoc sp.
atgttgcagcatacttggctaccaaaacccccaaatttaaccttattgtcagatgaagttcatctctggcgcattccccttgaccaaccagaatcacagctacaggatttagccgctaccttatctagtgacgaattagcccgtgcaaacagattttattttcccgaacatcgccggcgttttactgctggtcgtggtattctccgcagtatcttggggggctatttgggtgtggaaccagggcaagttaaatttgattatgaatcccgtggtaaaccaatattaggcgatcgctttgccgagagtggtttattatttaacttgtcacactcccagaacttggccttgtgtgcagtcaattacacgcgccaaatcggcatcgatttagaatatctccgccccacatctgatttagaatcccttgccaaaaggttctttttaccgcgagaatatgaattattgcgatcgctacccgatgagcaaaaacaaaaaattttctttcgttactggacttgtaaagaggcttatcttaaagcaacgggtgacggcatcgctaaattagaggaaattgaaatagcactaactcccacagaaccagctaagttacagacagctccagcgtggagtctcctagagctagtgccagatgataattgtgttgctgctgttgccgtggcgggttttggctggcagccaaaattctggcattattga

SEQ ID NO: 34 - protein, 237 aa, Nostoc sp.
MLQHTWLPKPPNLTLLSDEVHLWRIPLDQPESQLQDLAATLSSDELARANRFYFPEHRRRFTAGRGILRSILGGYLGVEPGQVKFDYESRGKPILGDRFAESGLLFNLSHSQNLALCAVNYTRQIGIDLEYLRPTSDLESLAKRFFLPREYELLRSLPDEQKQKIFFRYWTCKEAYLKATGDGIAKLEEIEIALTPTEPAKLQTAPAWSLLELVPDDNCVAAVAVAGFGWQPKFWHY

SEQ ID NO: 35 - DNA, 8733 bp, Artificial
  synthetic
atggctgctaggttgcaagaacaaaaaggtggtgagatggatactagaattgctatcattggaatgtctgctattttgccatgtggtactactgttagagaatcttgggaaactattagagctggtattgattgtttgtctgatttgcctgaagatagagttgatgttactgcttactttgatccagttaaaactactaaagataaaatctattgtaagagaggtggtttcattccagaatatgattttgatgctagagaatttggtttgaatatgtttcagatggaagattctgatgctaatcaaactatttctttgttgaaagttaaagaagcattgcaagatgctggcatcgatgctttgggtaaagagaagaagaatattggttgtgttttgggtattggtggtggtcaaaaatcttctcatgaattttactcaagattgaattatgttgttgttgagaaggtattgagaaaaatgggtatgccagaagaagatgttaaagttgctgttgaaaaatacaaagctaattttccagagtggagattggattcttttccaggtttcttgggaaatgttactgcaggaagatgtactaatacttttaatcttgatggcatgaattgtgttgttgatgctgcttgtgcttcttctttgattgctgttaaagttgctattgatgaattgttgtacggtgattgtgatatgatggttactggtgctacttgtactgataattctattggaatgtacatggctttttctaaaactccagttttctctactgatccatctgttagagcttatgatgaaaaaactaaaggaatgttgattggtgaaggttctgctatgttggttttgaaaagatatgctgatgctgttagagatggtgatgaaattcatgctgttattagaggttgtgcttcttcttctgatggtaaagctgctggtatctatactccaactatttctggtcaagaagaagcattgagaagagcttataatagagcttgtgttgatccagctactgttactttggttgaaggtcatggtactggtactccagttggtgatagaattgaattgactgctttgagaaatttgtttgataaagcatatggtgaaggtaatactgaaaaagttgctgttggttctattaaatcttctattggtcatttgaaagctgttgctggtttggctggaatgattaaagttatcatggctttgaaacataaaactttgccaggaactattaatgttgataatccaccaaacttgtacgataatactccaattaacgaatcttctttgtacattaatactatgaatagaccttggtttccaccaccaggtgttccaagaagagctggtatttcttcttttggttttggtggtgctaattatcatgctgttttggaagaagctgaaccagaacatactactgcttataggttgaacaaaagaccacaaccagttttgatgatggctgctactccagctgctttgcaatctttgtgtgaagctcaattgaaagaatttgaagctgctattaaagaaaacgaaactgttaaaaatactgcttatattaaatgtgttaaatttggtgaacaattcaaattccctggtagtattccagctactaatgctaggttgggtttcttggttaaagatgctgaagatgcttgttctactttgagagctatttgtgctcaatttgctaaagatgttactaaagaagcatggagattgccaagagaaggtgtttcttttagagctaaaggtattgctactaatggtgctgttgctgctttgttttctggtcaaggtgctcaatatactcatatgttttctgaagttgctatgaattggccacaattcagacaatctattgctgctatggatgctgctcaatctaaagttgctggttctgataaagattttgaaagagtttctcaagttttgtatccaagaaaaccatacgagagagaaccagagcaagatcataagaagatttctttgactgcttattctcaaccatctactttggcttgtgctttgggtgcttttgaaatttttaaagaagctggttttactccagattttgctgctggtcattctttgggtgaatttgctgctttgtacgctgctggttgtgttgatagagatgaattgtttgaattggtttgtagaagagctagaattatgggtggtaaagatgctccagctactccaaaaggttgcatggctgctgttattggtccaaatgctgaaaatattaaagttcaagctgctaatgtttggttaggaaattctaattctccatctcaaactgttattactggttctgttgaaggtattcaagctgaatctgctaggttgcaaaaagaaggttttagagttgttccattggcttgtgaatctgcttttcattctccacagatggaaaatgcttcttctgcttttaaagatgttatctctaaagtttcttttagaactccaaaagctgaaactaaattgttttctaatgtttctggtgaaacttatccaactgatgctagagaaatgttgactcaacatatgacttcttctgttaaatttttgactcaagttagaaatatgcatcaagctggtgctagaatttttgttgaattcggtccaaaacaagttttgtctaaattggtttctgaaactttgaaagatgatccatctgttgttactgtttctgttaatccagcttctggtactgattctgatattcaattgagagatgctgctgttcaattggttgttgctggtgttaatttgcaaggttttgataaatgggatgctccagatgctactagaatgcaagctattaaaaaaaaaagaactactttgagattgtctgctgctacttatgtttctgataaaactaagaaagttagagatgctgctatgaatgatggtagatgtgttacttacttgaaaggtgctgctccattgattaaagctccagaaccagttgttgatgaagctgctaaaagagaagctgaaagattgcaaaaagaattgcaagatgctcaaagacaattggatgatgctaaaagagctgctgctgaagctaattctaaattggctgctgctaaagaagaagctaaaactgctgctgcttctgctaaaccagctgttgatactgctgttgttgaaaaacatagagctattttgaaatctatgttggctgaattggatggttatggttctgttgatgcttcttctttgcaacaacaacaacaacaacaaactgctccagctccagttaaagctgctgctccagctgctccagttgcttctgctccagcacccgcagttagcaacgaactcttagaaaaagccgagacagtagtgatggaagttcttgcagctaaaacggggtacgaaacagatatgattgaagcagatatggaacttgaaactgaactgggcattgattcgattaaacgcgtggaaattctgtcagaagtgcaagctatgttaaatgttgaagcgaaagatgttgatgcactgtcacgcacacgcaccgtgggcgaagtagtgaacgccatgaaagcagaaattgcaggctcctcagcacccgcgccggccgcagcagcaccagcccccgcaaaagccgcccccgcagcggcggctccagccgtttcaaacgaattactcgaaaaagcagaaaccgtagtgatggaagtccttgccgccaaaacgggttatgagaccgatatgatcgaaagcgatatggaattagaaaccgaattagggattgatagtattaaacgcgtagaaattctgtccgaagtacaagctatgctgaatgtagaagcaaaagatgtagatgcgttaagccgcacacgcactgttggtgaagttgtgaatgctatgaaagctgaaattgcaggaggttcagcaccggccccagcagccgcagccccaggtccagcagcagccgcaccggcccccgccgccgccgcaccggcagtatcaaacgagttgttagagaaagcggaaaccgttgtgatggaagtacttgccgcgaagacaggttacgagaccgatatgatcgaaagtgacatggaattagaaaccgaattgggcattgatagcattaaacgcgtagaaattttatccgaagttcaagccatgttaaatgttgaagccaaagatgtggatgcgttatcccgcacgcgtaccgtcggagaagtagtggacgctatgaaagcagagattgcaggaggaagtgcaccggctccagcagcagcagcacccgccccagcggcagcggcgccggcaccggccgctccggccccagccgttagttcagaactcctcgaaaaagcagaaactgttgtcatggaagtattagctgcaaaaacaggttacgagacggatatgattgaaagcgatatggaattagaaaccgaattaggcattgattcaattaaacgtgttgaaatcttaagtgaagtccaagccatgcttaatgttgaagccaaagatgtagatgcattatctcgcacgcgtacagtgggtgaagttgtcgatgcgatgaaagcagaaatcgcgggaggatcagcgccagccccggcagcagcagcccccgcgcccgccgcggccgcacctgcgccggccgccccagcccctgcagcaccggccccagcagtgtcgtcggaattactcgaaaaagctgaaacggtcgttatggaagtacttgctgcaaagacgggctatgaaacggatatgattgaatcggatatggaattagaaacagaacttggtattgactctattaaacgcgtggaaattctgagcgaagtacaggcaatgttaaacgtagaagccaaagatgtagacgctttgtcacgcacacggacggtaggagaagttgtggatgcgatgaaagctgaaattgccggttcaagtgctagcgcccctgctgccgccgcccctgcccctgccgccgcagcaccggccccggcagccgcagctccagcagttagtaacgaattactcgaaaaagcagaaacggtggtcatggaagtgttagcagcaaaaactggatatgaaacggacatgattgaaagcgatatggaattagaaacagaactgggaattgatagtattaaacgtgttgagattttatctgaggttcaagctatgctgaatgttgaagcgaaagatgtagacgcactgtctcggacccgcacagtaggtgaagtggtggacgcgatgaaagcagaaatcgcaggtggaagtgctccggccccggcggcagccgcacccgcgcccgcggccgcagccccagcagttagcaacgaattactcgagaaagcagaaactgtagtgatggaagtgttagccgcaaaaacgggttatgaaacggatatgattgaaagcgatatggaactggaaaccgaactgggcattgattctattaaacgtgtcgaaatcttatcggaagtccaagcaatgctgaacgtagaggcaaaggatgttgatgccctgtcacgtacccgtaccgtaggtgaagttgtagatgccatgaaagctgaaatcgcaggcagtagcgccccggcaccagccgccgccgcccccgcgccggcagccgccgcacccgcgccagccgcagctgctccagctgtatctagtgagctgctcgaaaaagcagaaaccgtggttatggaagtgctcgccgctaaaacaggatatgaaaccgatatgattgaaagcgatatggaattagaaaccgaactgggtattgatagtattaagcgtgttgaaattttgtcagaagttcaagctatgttgaatgtagaagccaaagatgtagacgctttaagtcggacgcgtactgttggagaagtcgtagacgccatgaaagcagagattgcaggcggaagtgcaccggccccggcagcagcagccccagcaccagcggccgccgctcctgcagtgtcaaacgaacttctggaaaaagctgaaaccgtcgtcatggaagtgctggctgcaaaaactggatatgaaacagacatgattgaatcagatatggaactcgaaaccgaactggggattgatagcattaaacgtgtggaaattttatcggaggtacaagcaatgttaaatgtggaagcaaaagatgtggatgcactgagccgtactcgtactgttggtgaggtcgtggatgcgatgaaagcagaaattgctggagggagtgcgcctgccccggccgccgccgcacccgcgtctgccggtgctgcccccgctgtcaaaattgattctgttcatggtgctgattgtgatgatttgtctttgatgcatgctaaagttgttgatattagaagaccagatgaattgattttggaaagaccagaaaatagaccagttttggttgttgatgatggttctgaattgactttggctttggttagagttttgggtgcttgtgctgttgttttgacttttgaaggtttgcaattggctcaaagagctggtgctgctgctattagacatgttttggctaaagatttgtctgctgaatctgctgaaaaagctattaaagaagctgaacaaagatttggtgctttgggtggttttatctctcaacaagctgaaagatttgaaccagctgaaattttgggttttactttgatgtgtgctaaatttgctaaagcatctttgtgcactgctgttgctggtggtagaccagctttcattggtgttgctaggttggatggtaggttgggttttacttctcaaggaacttctgatgctttgaaaagagctcaaagaggtgctatttttggtttgtgcaagactattggtttggaatggtctgaatctgatgttttctcaagaggtgttgatattgctcaaggtatgcatccagaagatgctgctgttgctattgttagagaaatggcttgtgctgatattagaattagagaagttggtattggtgctaatcaacaaagatgtactattagagctgctaaattggaaactggaaatccacaaagacaaattgctaaagatgatgttttgttggtttctggtggtgctagaggaattactccattgtgcattagagaaattactagacaaattgctggtggaaagtatattttgttgggtaggtctaaagtttctgcttctgaaccagcttggtgtgctggtattactgatgaaaaagctgttcaaaaagctgctactcaagaattgaaaagagctttttctgctggtgaaggtccaaaaccaactccaagagctgttactaaattggttggttctgttttgggtgctagagaagttaggtcttctattgctgctattgaagcattgggtggaaaagctatctattcttcttgtgatgttaattctgctgctgatgttgctaaagctgttagagatgctgaatctcaattgggtgctagagtttctggtattgttcatgcttctggtgttttgagagataggttgattgaaaaaaaattgccagatgaatttgatgctgtttttggtactaaagttactggtttggaaaatttgttggctgctgttgatagagctaatttgaaacatatggttttgttttcttctttggctggttttcatggtaatgttggtcaatctgattatgctatggctaacgaagcattgaacaaaatgggtttggaattggctaaagatgtttctgttaaatctatttgttttggtccttgggatggtggtatggttactccacaattgaaaaaacaatttcaagaaatgggtgttcaaattattccaagagaaggtggtgctgatactgttgctagaattgttttgggttcttctccagctgaaattttggttggtaattggagaactccatctaaaaaagttggttctgatactattactttgcacagaaaaatttctgctaaatctaatccatttttggaagatcatgtcattcaaggtagaagagttttgccaatgactttggctattggttctttggctgaaacttgtttgggtttgtttcctggatattctttgtgggctattgatgatgctcaattgtttaaaggtgttactgttgatggtgatgttaattgtgaagttactttgactccatctactgctccttctggtagagttaatgttcaagctactttgaaaactttttcttctggtaaattggttccagcttatagagctgttattgttttgtctaatcaaggtgctccaccagctaatgctactatgcaaccaccatctttggatgctgatccagctttgcaaggttctgtttatgatggaaagactttgtttcatggtccagcttttagaggtattgatgatgttttgtcttgtactaaatctcaattggttgctaaatgttctgctgttccaggttctgatgctgctagaggtgaatttgctactgatactgatgctcatgatccatttgttaatgatttggcttttcaagctatgttggtttgggttagaagaactttgggtcaagctgctttgccaaattctattcaaagaattgttcaacacagaccagttccacaagataaaccattttatattactttgagatctaatcaatctggtggtcattctcaacataaacatgctttgcaatttcataacgaacaaggtgatttgttcattgatgttcaagcatctgttattgctactgattctttggctttttaa

SEQ ID NO: 36 - DNA, 6180 bp, Artificial
  synthetic
atggctgctagaaatgtttctgctgctcatgaaatgcatgatgaaaaaagaattgctgttgttggtatggctgttcaatatgctggttgtaagactaaagatgaattttgggaagttttgatgaatggtaaagttgaatctaaagttatctctgataaaagattgggttctaattaccgagctgaacattacaaggctgaaagatccaaatacgctgatactttttgtaacgaaacttatggtactttggatgaaaacgaaattgataacgaacatgaattgttgttgaatttggctaaacaagcattggctgaaacttctgttaaagattctactagatgtggtattgtttctggttgtttgtcttttcctatggataatttgcaaggtgaattgttgaatgtctatcaaaatcatgttgagaagaaattgggtgctagagtttttaaagatgcttctcattggtctgaaagagaacaatctaacaaaccagaagctggtgatagaagaattttcatggacccagcttcttttgttgctgaagaattgaatttgggtgctttgcattattctgttgatgctgcttgtgctactgctttatacgttttgagattggctcaagatcatttggtttctggtgctgctgatgttatgttgtgtggtgctacttgtttgccagaaccattctttatcttgtctggtttttctacttttcaagctatgccagttggtactggtcaaaatgtttctatgccattgcataaagattctcaaggtttgactccaggtgaaggtggttctatcatggttttgaaaagattggatgatgctattagagatggtgatcatatctatggtactttgttgggtgctaatgtttctaattctggcactggtttgccattgaaaccattgttgccatctgaaaaaaaatgtttgatggatacttatactagaattaatgttcatccacataaaattcaatatgttgaatgtcatgctactggtactccacaaggtgatagggttgaaattgatgctgttaaagcatgttttgaaggaaaagttccaagatttggtactactaaaggaaactttggtcatactttggttgctgctggttttgctggaatgtgcaaagttttgttgtctatgaaacatggtatcattccaccaactccaggtattgatgatgaaactaagatggacccattggttgtttctggtgaagctattccttggccagaaactaatggtgaaccaaaaagagctggtttgtctgcttttggttttggtggtactaatgctcatgctgtttttgaagaacatgatccatctaatgctgcttgtactggtcatgattctatttctgctttgtctgctagatgtggtggtgaatctaatatgagaattgctattactggtatggatgctacttttggtgctttgaaaggtttggatgcttttgaaagagccatctacactggtgctcatggtgctattccattgccagaaaagagatggagatttttgggcaaagataaagatttcttggatttgtgtggtgttaaagctactccacatggttgttatattgaagatgttgaagttgattttcaaagattgagaactccaatgactccagaagatatgttgttgccacaacaattgttggctgttactactattgatagagctattttggattctggtatgaaaaaaggtggtaatgttgctgtttttgttggtttgggtaccgatttggaattgtacagacatagagctagagttgctttgaaagaaagagttagaccagaagcatctaaaaaattgaatgatatgatgcagtacattaatgattgtggcacctctacttcttatacttcttatattggtaatttggttgctactagagtttcttctcaatggggttttactggtccatcttttactattactgaagggaataactctgtttatagatgtgctgaattgggaaagtatttgttggaaactggtgaagttgatggtgttgttgttgctggtgttgatttgtgtggttctgctgaaaacttatacgttaaatcaagaagattcaaagtttctacttctgatactccaagagcttcttttgatgctgctgctgatggttactttgttggtgaaggttgtggtgcttttgttttgaaaagagaaacttcttgtactaaagatgatagaatctatgcttgcatggatgctattgttccaggtaatgttccatctgcttgtttgagagaagcattggatcaagctagagttaaaccaggtgatattgaaatgttggaattgtctgctgattctgctagacatttgaaagatccatctgttttgccaaaagaattgactgctgaagaagaaattggtggtttgcaaactattttgagagatgatgataaattgccaagaaatgttgctactggttctgttaaagctactgttggtgatactggttatgcttctggtgctgcttctttgattaaagctgctttgtgcatctataataggtatttgccatctaatggtgatgattgggatgaaccagctccagaagctccttgggattctactttgtttgcttgtcaaacttcaagagcttggttgaaaaatcctggagagagaagatatgctgctgtttctggtgtttctgaaactaggtcttgttattctgttttgttgtctgaagctgaaggtcattatgaaagagaaaatagaatttctttggatgaagaagctccaaaattgattgttttgagagctgattctcatgaagaaattttgggtaggttggataaaattagagaaagatttttgcaaccaactggtgctgctccaagagaatctgaattgaaagctcaagctagaagaattttcttggaattgttgggtgaaactttggctcaagatgctgcttcttctggttctcaaaaaccattggctttgtctttggtttctactccatctaaattgcaaagagaagttgaattggctgctaaaggtattccaagatgtttgaaaatgagaagagattggtcttctccagctggttcaagatatgctccagaaccattggcttctgatagagttgctttcatgtacggtgaaggaaggtctccatactatggaatcactcaagatattcatagaatttggccagaattgcatgaagttattaacgaaaaaactaataggttgtgggctgaaggtgatagatgggttatgccaagagcttcttttaaatctgaattggaatctcaacaacaagaatttgatagaaatatgattgaaatgtttaggttgggtattttgacttctattgcttttactaatttggctagagatgttttgaatattactccaaaagctgcttttggtttgtctttgggtgaaatttctatgatttttgctttttctaaaaaaaatggtttgatttctgatcaattgactaaagatttgagagaatctgatgtttggaacaaagcattggctgttgaattcaatgctttgagagaagcatggggtattccacaatctgttccaaaagatgaattttggcaaggttatattgttagaggtactaaacaagatattgaagctgctattgctccagattccaaatacgttaggttgactatcattaatgatgctaatactgctttgatttctggtaaaccagatgcttgtaaagctgctattgctaggttgggtggtaatattccagctttgccagttactcaaggaatgtgtggtcattgtccagaagttggtccatatactaaagatattgctaaaattcatgctaatttggaatttccagttgttgatggtttggatttgtggactactattaatcaaaaaagattggttccaagagctactggtgctaaagatgaatgggctccatcttcttttggtgaatatgctggtcaactttacgaaaaacaagctaattttccacaaattgttgaaactatctacaaacaaaattatgatgtttttgttgaggttggtccaaacaaccataggtctactgctgttagaactactttgggtccacaaagaaatcatttggctggtgctattgataaacaaaacgaagatgcttggactactattgttaaattggttgcttctttgaaagctcatttggttccaggtgttactatttctccattgtatcattctaaattggttgctgaagctgaagcatgttatgctgctctgtgcaaaggagaaaaacctaagaagaacaaatttgttagaaaaattcaattgaatggtaggttcaattctaaagctgatccaatttcttctgctgatttggcttcttttccaccagctgatccagctattgaagctgctatttcttcaagaattatgaaaccagttgctccaaaattttatgctaggttgaatattgatgaacaagacgaaacaagagatccaattttgaacaaagataatgctccatctagttcatctagttcctcttcatctagttcttcatctagttctccatctccagctccttctgctccagttcaaaaaaaagctgctccagctgctgaaactaaagctgttgcttctgctgatgctttgagatctgctttgttggatttggattctatgttggctttgtcttctgcttctgcttctggtaatttggttgaaactgctccatctgatgcttctgttattgttccaccatgtaatattgctgatttgggttcaagagcttttatgaaaacttatggtgtttctgctccattgtacactggtgctatggctaaaggtattgcttctgctgatttggttattgctgctggtagacaaggcattttggcttcttttggtgctggtggtttgccaatgcaagttgttagagaatctattgaaaaaattcaagctgctttgccaaatggtccatatgctgttaatttgattcattctccatttgattctaatttggaaaaaggtaatgttgatttgtttttggaaaaaggtgttacttttgttgaagcatctgcttttatgactttgactccacaagttgttaggtacagagctgctggtttgactagaaatgctgatggttctgttaatattagaaatagaattatcggaaaggtttcaagaactgaattggctgaaatgtttatgagacctgccccagaacacttgttgcaaaaattgattgcttctggtgaaattaatcaagaacaagctgaattggctagaagagttccagttgctgatgatattgctgttgaagctgattctggtggtcatactgataatagaccaattcatgttatcttgccattgattattaatttgagagacagattgcatagagaatgtggttatccagctaatttgagagttagagttggtgctggtggtggtattggttgtccacaagctgctttggctacttttaatatgggtgcttctttcattgttactggcactgttaatcaagttgctaaacaatctggtacttgtgataatgttagaaaacaattggctaaagctacttattctgatgtttgcatggctccagctgctgatatgtttgaagaaggtgttaaattgcaagttttgaagaaagggacaatgtttccatcaagagctaataagttatacgaattgttttgcaagtatgattcttttgaatctatgccaccagctgaattggctagagttgaaaaaagaattttctcaagagctttggaagaagtttgggatgaaactaaaaatttttacattaataggttgcacaatccagaaaaaattcaaagagctgaaagagatccaaaattgaaaatgtctttgtgttttagatggtatttgtctttggcttcaagatgggctaatactggtgcttctgatagagttatggattatcaagtttggtgtggtccagctattggttcttttaatgatttcattaaaggcacctacttggacccagctgttgctaacgaatatccatgcgttgttcaaattaacaaacaaattttgagaggtgcttgtttcctcagaagattggaaattttgagaaatgctaggttgtctgatggtgctgctgctttggttgcttctattgatgatacttatgttccagctgaaaaattgtaa

SEQ ID NO: 37 - DNA, 6180 bp, Artificial
  synthetic
atggccgctcgcaacgtgtctgcagcgcatgagatgcacgatgaaaagcgcatcgccgtcgtcggcatggccgtccagtacgccggatgcaaaaccaaggacgagttctgggaggtgctcatgaacggcaaggtcgagtccaaggtgatcagcgacaaacgactcggctccaactaccgcgccgagcactacaaagcagagcgcagcaagtatgccgacaccttttgcaacgaaacgtacggcacccttgacgagaacgagatcgacaacgagcacgaactcctcctcaacctcgccaagcaggcactcgcagagacatccgtcaaagactcgacacgctgcggcatcgtcagcggctgcctctcgttccccatggacaacctccagggtgaactcctcaacgtgtaccaaaaccatgtcgagaaaaagctcggggcccgcgtcttcaaggacgcctcccattggtccgaacgcgagcagtccaacaaacccgaggccggtgaccgccgcatcttcatggacccggcctccttcgtcgccgaagaactcaacctcggcgcccttcactactccgtcgacgcagcatgcgccacggcgctctacgtgctccgcctcgcgcaggatcatctcgtctccggcgccgccgacgtcatgctctgcggtgccacctgcctgccggagccctttttcatcctttcgggcttttccaccttccaggccatgcccgtcggcacgggccagaacgtgtccatgccgctgcacaaggacagccagggcctcaccccgggtgagggcggctccatcatggtcctcaagcgtctcgatgatgccatccgcgacggcgaccacatctacggcacccttctcggcgccaatgtcagcaactccggcacaggtctgcccctcaagccccttctccccagcgagaaaaagtgcctcatggacacctacacgcgcattaacgtgcacccgcacaagattcagtacgtcgagtgccacgccaccggcacgccccagggtgatcgtgtggaaatcgacgccgtcaaggcctgctttgaaggcaaggtcccccgtttcggtaccacaaagggcaactttggacacaccctcgtcgcagccggctttgccggtatgtgcaaggtcctcctctccatgaagcatggcatcatcccgcccaccccgggtatcgatgacgagaccaagatggaccctctcgtcgtctccggtgaggccatcccatggccagagaccaacggcgagcccaagcgcgccggtctctcggcctttggctttggtggcaccaacgcccatgccgtctttgaggagcatgacccctccaacgccgcctgcacgggccacgactccatttctgcgctctcggcccgctgcggcggtgaaagcaacatgcgcatcgccatcactggtatggacgccacctttggcgctctcaagggactcgacgccttcgagcgcgccatttacaccggcgctcacggtgccatcccactcccagaaaagcgctggcgctttctcggcaaggacaaggactttcttgacctctgcggcgtcaaggccaccccgcacggctgctacattgaagatgttgaggtcgacttccagcgcctccgcacgcccatgacccctgaagacatgctcctccctcagcagcttctggccgtcaccaccattgaccgcgccatcctcgactcgggaatgaaaaagggtggcaatgtcgccgtctttgtcggcctcggcaccgacctcgagctctaccgtcaccgtgctcgcgtcgctctcaaggagcgcgtccgccctgaagcctccaagaagctcaatgacatgatgcagtacattaacgactgcggcacatccacatcgtacacctcgtacattggcaacctcgtcgccacgcgcgtctcgtcgcagtggggcttcacgggcccctcctttacgatcaccgagggcaacaactccgtctaccgctgcgccgagctcggcaagtacctcctcgagaccggcgaggtcgatggcgtcgtcgttgcgggtgtcgatctctgcggcagtgccgaaaacctttacgtcaagtctcgccgcttcaaggtgtccacctccgataccccgcgcgccagctttgacgccgccgccgatggctactttgtcggcgagggctgcggtgcctttgtgctcaagcgtgagactagctgcaccaaggacgaccgtatctacgcttgcatggatgccatcgtccctggcaacgtccctagcgcctgcttgcgcgaggccctcgaccaggcgcgcgtcaagccgggcgatatcgagatgctcgagctcagcgccgactccgcccgccacctcaaggacccgtccgtcctgcccaaggagctcactgccgaggaggaaatcggcggccttcagacgatccttcgtgacgatgacaagctcccgcgcaacgtcgcaacgggcagtgtcaaggccaccgtcggtgacaccggttatgcctctggtgctgccagcctcatcaaggctgcgctttgcatctacaaccgctacctgcccagcaacggcgacgactgggatgaacccgcccctgaggcgccctgggacagcaccctctttgcgtgccagacctcgcgcgcttggctcaagaaccctggcgagcgtcgctatgcggccgtctcgggcgtctccgagacgcgctcgtgctattccgtgctcctctccgaagccgagggccactacgagcgcgagaaccgcatctcgctcgacgaggaggcgcccaagctcattgtgcttcgcgccgactcccacgaggagatccttggtcgcctcgacaagatccgcgagcgcttcttgcagcccacgggcgccgccccgcgcgagtccgagctcaaggcgcaggcccgccgcatcttcctcgagctcctcggcgagacccttgcccaggatgccgcttcttcaggctcgcaaaagcccctcgctctcagcctcgtctccacgccctccaagctccagcgcgaggtcgagctcgcggccaagggtatcccgcgctgcctcaagatgcgccgcgattggagctcccctgctggcagccgctacgcgcctgagccgctcgccagcgaccgcgtcgccttcatgtacggcgaaggtcgcagcccttactacggcatcacccaagacattcaccgcatttggcccgaactccacgaggtcatcaacgaaaagacgaaccgtctctgggccgaaggcgaccgctgggtcatgccgcgcgccagcttcaagtcggagctcgagagccagcagcaagagtttgatcgcaacatgattgaaatgttccgtcttggaatcctcacctcaattgccttcaccaatctggcgcgcgacgttctcaacatcacgcccaaggccgcctttggcctcagtcttggcgagatttccatgatttttgccttttccaagaagaacggtctcatctccgaccagctcaccaaggatcttcgcgagtccgacgtgtggaacaaggctctggccgttgaatttaatgcgctgcgcgaggcctggggcattccacagagtgtccccaaggacgagttctggcaaggctacattgtgcgcggcaccaagcaggatatcgaggcggccatcgccccggacagcaagtacgtgcgcctcaccatcatcaatgatgccaacaccgccctcattagcggcaagcccgacgcctgcaaggctgcgatcgcgcgtctcggtggcaacattcctgcgcttcccgtgacccagggcatgtgcggccactgccccgaggtgggaccttataccaaggatatcgccaagatccatgccaaccttgagttccccgttgtcgacggccttgacctctggaccacaatcaaccagaagcgcctcgtgccacgcgccacgggcgccaaggacgaatgggccccttcttcctttggcgagtacgccggccagctctacgagaagcaggctaacttcccccaaatcgtcgagaccatttacaagcaaaactacgacgtctttgtcgaggttgggcccaacaaccaccgtagcaccgcagtgcgcaccacgcttggtccccagcgcaaccaccttgctggcgccatcgacaagcagaacgaggatgcttggacgaccatcgtcaagcttgtggcttcgctcaaggcccaccttgttcctggcgtcacgatctcgccgctgtaccactccaagcttgtggcggaggctgaggcttgctacgctgcgctctgcaagggtgaaaagcccaagaagaacaagtttgtgcgcaagattcagctcaacggtcgcttcaacagcaaggcggaccccatctcctcggccgatcttgccagctttccgcctgcggaccctgccattgaagccgccatctcgagccgcatcatgaagccggttgctccgaagttctacgcgcgtctcaacattgacgagcaggacgagacccgtgatccgatcctcaacaaggacaacgcgccgtcttccagctctagctcctcttccagctcttccagctcttccagcccgtcgccagctccgtccgccccagtgcaaaagaaggctgctccggccgcggagaccaaggctgttgcttcggctgacgcacttcgcagtgccctgctcgatctcgacagtatgcttgcgctgagctctgccagtgcctccggcaaccttgttgagactgcgcctagcgacgcctcggtcattgtgccgccctgcaacattgcggatctcggcagccgcgccttcatgaaaacgtacggtgtttcggcgcctctgtacacgggcgccatggccaagggcattgcctctgcggacctcgtcattgccgccggccgccagggcatccttgcgtcctttggcgccggcggacttcccatgcaggttgtgcgtgagtccatcgaaaagattcaggccgccctgcccaatggcccgtacgctgtcaaccttatccattctccctttgacagcaacctcgaaaagggcaatgtcgatctcttcctcgagaagggtgtcacctttgtcgaggcctcggcctttatgacgctcaccccgcaggtcgtgcggtaccgcgcggctggcctcacgcgcaacgccgacggctcggtcaacatccgcaaccgtatcattggcaaggtctcgcgcaccgagctcgccgagatgttcatgcgtcctgcgcccgagcaccttcttcagaagctcattgcttccggcgagatcaaccaggagcaggccgagctcgcccgccgtgttcccgtcgctgacgacatcgcggtcgaagctgactcgggtggccacaccgacaaccgccccatccacgtcattctgcccctcatcatcaaccttcgcgaccgccttcaccgcgagtgcggctacccggccaaccttcgcgtccgtgtgggcgccggcggtggcattgggtgcccccaggcggcgctggccaccttcaacatgggtgcctcctttattgtcaccggcaccgtgaaccaggtcgccaagcagtcgggcacgtgcgacaatgtgcgcaagcagctcgcgaaggccacttactcggacgtatgcatggccccggctgccgacatgttcgaggaaggcgtcaagcttcaggtcctcaagaagggaaccatgtttccctcgcgcgccaacaagctctacgagctcttttgcaagtacgactcgttcgagtccatgccccccgcagagcttgcgcgcgtcgagaagcgcatcttcagccgcgcgctcgaagaggtctgggacgagaccaaaaacttttacattaaccgtcttcacaacccggagaagatccagcgcgccgagcgcgaccccaagctcaagatgtcgctgtgctttcgctggtacctgagcctggcgagccgctgggccaacactggagcttccgatcgcgtcatggactaccaggtctggtgcggtcctgccattggttccttcaacgatttcatcaagggaacttaccttgatccggccgtcgcaaacgagtacccgtgcgtcgttcagattaacaagcagatccttcgtggagcgtgcttcttgcgccgtctcgaaattctgcgcaacgcacgcctttccgatggcgctgccgctcttgtggccagcatcgatgacacatacgtcccggccgagaagctgtaa

SEQ ID NO: 38 - DNA, 8436 bp, Thraustochytrium sp.
  CDS (1)..(8433)
atgaaggacatggaagatagacgggtcgctattgtgggcatgtcagctcacttgccttgtgggacagatgtgaaggaatcatggcaggctattcgcgatggaatcgactgtctaagtgacctacccgcggatcgtctcgacgttacagcttactacaatcccaacaaagccacgaaagacaagatctactgcaaacggggtggcttcatcccgaactatgacttcgacccccgcgaatttgggctcaacatgtttcaaatggaagactctgatgcgaatcagacacttaccttgctcaaagtcaaacaagctctcgaagatgcaagcatagagcctttcaccaaggagaagaagaacattggatgtgttttaggtattggtgggggccaaaaggcgagtcatgagttctactctcgtctcaactacgttgtcgttgaaaaggtacttcggaaaatgggtttaccagatgctgatgttgaagaagctgtggagaaatacaaggcaaattttcccgagtggcgcctagactctttccctgggtttcttgggaatgtaacggctggtcggtgcagtaacaccttcaacatggaaggtatgaactgcgttgtggatgctgcatgtgccagttctctaattgcaatcaaggttgcagttgaagagctactctttggtgactgtgacaccatgattgcaggtgccacctgcacggacaattcacttggcatgtacatggccttctctaaaacgccagttttttctactgacccaagtgtccgcgcgtatgatgagaaaacaaaagggatgctaattggagaaggttcagcaatgttcgttcttaaacgctatgcggatgccgtacgtgatggcgacacaattcacgcggttctgcgttcttgctcttcgtctagtgatggaaaagcggcaggaatttatactcctactatatctggacaagaagaagctttgcgtcgagcgtatgcccgtgcgggggtatgtccatctacgatcgggcttgttgagggtcacgggacagggacccctgttggagatcgcattgagttaacagctctgcggaacttgtttgacaaagcttttggtagcaagaaggaacaaatagcagttggcagcataaagtctcagataggtcacctgaaatctgttgccggctttgccggcttggtcaaagctgtgcttgcgcttaaacacaaaacgctcccaggttcgattaatgtcgaccagccacctttgttgtatgacggtactcaaattcaagactcttctttatatatcaacaagacaaatagaccatggtttacgcaaaacaagcttccgcgtcgggctggtgtctcaagttttggatttggaggtgcaaactaccacgcggttctggaagaattcgagcccgagcatgaaaaaccataccgcctcaatactgttggacatcctgtcctcttgtacgctccgtctgtggaagccctcaaagtactttgcaacgaccagcttgcggagctcacaattgcattggaagaggcaaaaacacataaaaatgttgacaaagtttgtggctacaagtttattgacgaatttcagctccaaggaagctgtcctccagaaaatccgagagtaggatttttagcaacactgcctacttcaaatatcattgtcgcgcttaaggcaattctcgcgcagcttgatgcaaaaccagatgcgaagaaatgggatttgcctcataaaaaggcttttggggctaccttcgcatcgtcttcagtgaaaggctctgttgctgcgctcttcgcaggacagggtacccagtacttaaacatgttctctgatgtggcaatgaactggccaccgttccgtgacagcattgtcgcaatggaagaagctcaaactgaggtatttgagggccaagttgaaccaattagcaaagttctgtttccacgagagcgctatgcatccgaaagtgaacaggggaatgaacttctttgcttaacagagtactctcagccaactacgatagcagccgcagtaggggccttcgatattttcaaagcggctggctttaagccagacatggttggagggcattcacttggcgaatttgctgctttgtacgcggctgggtccatttcgcgtgacgacctgtacaagcttgtgtgcaaacgggcaaaggcaatggcgaacgctagtgacggagctatggcagcagtgattggcccagatgcacgtctagttacgccacaaaatagtgacgtttatgtcgcaaacttcaactccgcaactcaagtagtcatcagtggcactgttcaaggtgtgaaagaagagtcgaaattgctcatttcaaaggggttccgcgtactgccacttaaatgccagggcgccttccattctcctttgatggggccttctgaggatagtttcaaatcacttgtggagacttgtaccatctcgccgccaaaaaatgtgaaattcttttgcaatgttagtggcaaggaaagcccaaacccaaaacagaccctcaagtcacacatgacgtctagcgttcagttcgaggagcagattcgtaacatgtacgatgccggagcacgtgtttttctggagtttggaccccgccaagtccttgcaaagcttatcgcggaaatgtttccctcgtgtacagctatcagcgttaaccccgcgagcagtggtgacagtgacgtgcaactccgcctcgccgccgtaaaattcgcggtctcgggtgcagcccttagcacctttgatccatgggagtatcgcaagccacaagatcttcttattcgaaaaccacgaaaaactgcccttgttctatcagcagcaacatatgtttccccaaagactcttgcagaacgtaaaaaggctatggaagatatcaagctagtatccattacaccaagagatagtatggtatcaattggaaaaatcgcgcaagaagtacggacagctaaacagcctttagaaaccgaaattcgaagactcaacaaagaattagaacatctcaagagagagctagcagcagccaaagcgagtgtcaagtctgcatcaaaaagctctaaagagcgatctgtcctatcaaagcaccgcgctttgcttcaaaacattttgcaagactacgatgatcttcgtgtggtgccattcgctgttcgttctgttgcagtggacaacaccgcgccgtatgctgaccaagtttcgaccccagcgtcagagcggtcggcttcaccgcttttcgagaaacgcagttcggtttcgtcagcacgcctcgctgaagctgaagccgcggtactgagcgttctcgcagacaagacaggctacgacagctcaatgatcgagatggacatggacctggagagtgagcttggcgttgatagcatcaaacgcgtggagatcatgagcgaggttcaaacgctgctcagcgtggaagtctccgacgttgacgctctgtcaagaaccaagactgttggcgacgtcatcgaggcgatgaagctggaactcggtggaccccaaggccagactttgaccgcggaatcgatccgtcagccaccggtgtccgagcctgctgtaccgacctcatcgtcaagcagtattgctaatgtttcgtcagcacgcctcgctgaagctgaagctgcggtactgagcgttctcgcagacaagacaggctacgacagctcaatgatcgagatggacatggacctggagagcgagcttggcgttgatagcatcaaacgcgtggagatcatgagcgaggttcaaacgctgctcagcgtggaagtctccgacgttgacgctctgtcaagaactaagactgttggcgacgtcatcgaggcgatgaagctggaactcggtggaccccaaggccagactttgaccgcggaatcgatccgtcagccaccggtgtctgagcctgctgtaccgacctcatcgtcaagcagtattgctaatgtttcgtcagcacgcctcgctgaagctgaagcggcggtactgagcgttctcgcagacaagacaggctacgacagctcaatgatcgagatggacatggacctggagagcgagcttggcgtcgacagcatcaaacgcgtggagatcatgagcgaggttcaaacgctgctcagcgtggaagtctccgacgttgacgctctgtcaagaaccaagactgttggcgacgtcatcgaggcgatgaagctggaactcggtggaccccaaggccagactttgaccgcggaatcgatccgtcagccaccggtgtccgagcctgctgtaccgacctcatcgtcaagcagtattgctaatgttttgtcagcacgcctcgctgaagctgaagccgcggtactgagcgttctcgcagacaagacaggctacgacagctcaatgatcgagatggacatggacctggagagcgagcttggcgttgatagcatcaaacgcgtggagatcatgagcgaggttcaaacgttgctcagcgtggaagtctccgacgttgacgctctgtcaagaaccaagactgttggcgacgtcatcgaggcgatgaagctggaactcggtggaccccaaggccagactttgaccgcggaatcgatccgtcagccaccggtgtctgagcctgctgtaccgacctcatcgtcaagcagtattgctaatgtttcgtcagcacgcctcgctgaagctgaagccgcggtactgagcgttctcgcagacaagacaggctacgacagctcaatgatcgagatggacatggacctggagagtgagcttggcgtcgacagcatcaaacgcgtggagatcatgagcgaggttcaaacgctgctcagcgtggaagtctccgacgttgacgctctgtcaagaaccaagactgttggcgacgtcatcgaggcgatgaagctggaactcggtggaccccaaggccagactttgacctctgaaccgatccatcagccaccagtgtccgagcctgctgtaccgacctcatcgtcaagcagtattgctaatgtttcttcagcacgcctcgctgaagctgaagccgcggtactgagcgttctcgcagacaagacaggctacgacagctcaatgatcgagatggacatggacctggagagcgagcttggcgttgatagcatcaaacgcgtggaaatcatgagcgaggttcaaacgctgctcagcgtggaagtctccgacgttgacgctctgtcaagaaccaagactgttggcgacgtcatcgaggcgatgaagatggaactcggtggaccccaaggccagactttgaccgcggaatcgatccgtcagccaccggtgtctgagcctgctgtaccgacctcatcgtcaagcagtattgctaatgtttcgtcagcacgcctcgctgaagctgaagcggcggtactgagcgttctcgcagacaagacaggctacgacagctcaatgatcgagatggacatggacctggagagcgagcttggcgttgatagcatcaaacgcgtggagatcatgagcgaggttcaagcgctgctcagcgtggaagtctccgacgttgacgctctgtcaagaaccaagactgttggcgacgtcatcgaggcgatgaagatggaactcggtggaccccaaggccagactttgaccgcagaatcgatccgtgagccaccggtgtctgagcctgctgtaccgacctcatcgtcaagtagtatcgctaatgtttcttcagctcgcctcgctgaagctgaagccgcggtactgagcgttctcgcagacaagacaggctacgacagctcaatgatcgagatggacatggacctggagagtgagcttggcgtcgacagcatcaaacgcgtggagatcatgagcgaggttcaaacgttgctcagcgtggaagtctccgacgttgacgctctgtcaagaaccaagactgttggcgacgtcatcgaggcgatgaagctggaacttggggaatcatcaagtattgagactctcaattgtaccgaggttgagcacacgagctacaaaagtgtcaaggcttcagggtgtgagaatgtagatacccgtttcgctaaggttgtacaaatctcgcttcctagcaagctgaaatccactgtgtcgcacgatcgacctgtaattgttgtagatgatggaacgcccttaaccacggagctttgtaaaattcttgggggtaatattgtggttctctcttatcaagggaagcccgctggtccacggggagtcgaggtgccagatctttccgaggaagccctaattcaagctcttgcattgattcggtctacatatggagttccaattggttttatttgtcagcaagtgtctaatgtgagcaccaaggcacagctttgttgggcactcctcgcagcgaagcatctcaagaaggatttgaatgctgtcttacccgattcaagatccttcttcgtcggagttgtacgcttgaacgggaaacttggaactttcgaaaacatcagcgacttctctaaatttgatttgacgaaagccctagattacggacagcgtggttctctcttaggcctgtgcaagtcactagacttagaatgggaacaggtgttttgccgtggaatagatcttgcgtgtgatcttatgccactccaggccgcaaggatactcagaaatgagcttcagtgtcccaatatgcgccttcgcgaggttgggtacgatatttctggcgccaggtacaccatttcaaccgatgacctgctatgtggaccctcgaaggctaaagtagaggccgcagacttgtttcttgtgacaggtggcgcacgaggtattacacctcattgtgttcgtgagattgcaagtcgatcccccggaaccacatttgtgctggttggaagaagcgaaatgtccgacgagcctgactgggctgttggccactacaataaagacctggaccaaagcacaatgaaacacttgaaagcaacgcatgctgctggaggggtaaaacctacgcctaaagcacatcgtgcacttgtgaacagggtcactggctcacgggaggtacgagaatctcttagagcaatccaggaggcaggggcaaatgtcgaatatatcgcctgtgatgtttcggatgaaaacaaggtccgccaacttgtgcaaagagtggagcaaaagtatggctgtgaaataactgggatttggcatgcaagcggggttcttcgtgacaaacttgtcgagcaaaagactacagacgactttgaggcagtttttgggaccaaggtgactggccttgtaaacatcgtgtcacaagtcaatatgtctaagctacgacacttcatcctcttcagttctttggctggatttcatgggaacaagggccaaacggattatgcaattgctaatgaagccttgaacaaaatcgcgcatactctctcagcgtttttgcccaaactgaatgcaaaggtgctagacttcggtccgtgggtaggttcaggaatggtaaccgaaacacttgagaagcattttaaagctatgggggttcagactattcctctcgagccaggagcacggactgttgcgcaaatcattttggcaagttcgccaccgcaatcgcttttggggaactggggctttccagccaccaaaccgctacaacgctctaatgtagtcacgggcacactctctccggaagagatagaattcatcgcagaccacaaaattcaaggccgcaaggtgcttcccatgatggctgcaatcgggttcatggcctctattgcggaaggactctacccggggtacaatctgcaaggcgtggaaaatgctcagctctttcaaggcttgactatcaaccaagagacaaaatttcaaatcactctcattgaggagcacaactctgaggaaaacctggatgtcctgacatcccttggtgtaatgttggaaagcgggaaggtgcttcccgcttaccgatgtgttgtatgcttgaatacaacccagcagcagcccaagctatctccaaaaattcttaacttggaagttgaccctgcatgcgaggttaacccctatgatggaaagtcgttgttccacggtccgcttttgcaattcgttcaacaagtgttgcactcaagtaccaaaggcctcgttgccaagtgccgcgcgcttccaatcaaagaagccatccgagggccatttatcaagcaaacactccatgatccaattctagacgacgtcatttttcagctaatgctcgtgtggtgtcgtaatgctctaggaagtgcatcgctacccaacagaattgaaaagatgtcatactttgggaatgtctcagaaggtagcactttctttgcctcagttacacctgtgggaccaagagtaccaaaggatcccgtgatcaaaatgcagtttcttctccaagatgaatccggcaacacattttcatcgggggagggctcggttgtgcttagtgacgaactcgtcttttga

SEQ ID NO: 39 - protein, 2811 aa, Thraustochytrium sp.
MKDMEDRRVAIVGMSAHLPCGTDVKESWQAIRDGIDCLSDLPADRLDVTAYYNPNKATKDKIYCKRGGFIPNYDFDPREFGLNMFQMEDSDANQTLTLLKVKQALEDASIEPFTKEKKNIGCVLGIGGGQKASHEFYSRLNYVVVEKVLRKMGLPDADVEEAVEKYKANFPEWRLDSFPGFLGNVTAGRCSNTFNMEGMNCVVDAACASSLIAIKVAVEELLFGDCDTMIAGATCTDNSLGMYMAFSKTPVFSTDPSVRAYDEKTKGMLIGEGSAMFVLKRYADAVRDGDTIHAVLRSCSSSSDGKAAGIYTPTISGQEEALRRAYARAGVCPSTIGLVEGHGTGTPVGDRIELTALRNLFDKAFGSKKEQIAVGSIKSQIGHLKSVAGFAGLVKAVLALKHKTLPGSINVDQPPLLYDGTQIQDSSLYINKTNRPWFTQNKLPRRAGVSSFGFGGANYHAVLEEFEPEHEKPYRLNTVGHPVLLYAPSVEALKVLCNDQLAELTIALEEAKTHKNVDKVCGYKFIDEFQLQGSCPPENPRVGFLATLPTSNIIVALKAILAQLDAKPDAKKWDLPHKKAFGATFASSSVKGSVAALFAGQGTQYLNMFSDVAMNWPPFRDSIVAMEEAQTEVFEGQVEPISKVLFPRERYASESEQGNELLCLTEYSQPTTIAAAVGAFDIFKAAGFKPDMVGGHSLGEFAALYAAGSISRDDLYKLVCKRAKAMANASDGAMAAVIGPDARLVTPQNSDVYVANFNSATQVVISGTVQGVKEESKLLISKGFRVLPLKCQGAFHSPLMGPSEDSFKSLVETCTISPPKNVKFFCNVSGKESPNPKQTLKSHMTSSVQFEEQIRNMYDAGARVFLEFGPRQVLAKLIAEMFPSCTAISVNPASSGDSDVQLRLAAVKFAVSGAALSTFDPWEYRKPQDLLIRKPRKTALVLSAATYVSPKTLAERKKAMEDIKLVSITPRDSMVSIGKIAQEVRTAKQPLETEIRRLNKELEHLKRELAAAKASVKSASKSSKERSVLSKHRALLQNILQDYDDLRVVPFAVRSVAVDNTAPYADQVSTPASERSASPLFEKRSSVSSARLAEAEAAVLSVLADKTGYDSSMIEMDMDLESELGVDSIKRVEIMSEVQTLLSVEVSDVDALSRTKTVGDVIEAMKLELGGPQGQTLTAESIRQPPVSEPAVPTSSSSSIANVSSARLAEAEAAVLSVLADKTGYDSSMIEMDMDLESELGVDSIKRVEIMSEVQTLLSVEVSDVDALSRTKTVGDVIEAMKLELGGPQGQTLTAESIRQPPVSEPAVPTSSSSSIANVSSARLAEAEAAVLSVLADKTGYDSSMIEMDMDLESELGVDSIKRVEIMSEVQTLLSVEVSDVDALSRTKTVGDVIEAMKLELGGPQGQTLTAESIRQPPVSEPAVPTSSSSSIANVLSARLAEAEAAVLSVLADKTGYDSSMIEMDMDLESELGVDSIKRVEIMSEVQTLLSVEVSDVDALSRTKTVGDVIEAMKLELGGPQGQTLTAESIRQPPVSEPAVPTSSSSSIANVSSARLAEAEAAVLSVLADKTGYDSSMIEMDMDLESELGVDSIKRVEIMSEVQTLLSVEVSDVDALSRTKTVGDVIEAMKLELGGPQGQTLTSEPIHQPPVSEPAVPTSSSSSIANVSSARLAEAEAAVLSVLADKTGYDSSMIEMDMDLESELGVDSIKRVEIMSEVQTLLSVEVSDVDALSRTKTVGDVIEAMKMELGGPQGQTLTAESIRQPPVSEPAVPTSSSSSIANVSSARLAEAEAAVLSVLADKTGYDSSMIEMDMDLESELGVDSIKRVEIMSEVQALLSVEVSDVDALSRTKTVGDVIEAMKMELGGPQGQTLTAESIREPPVSEPAVPTSSSSSIANVSSARLAEAEAAVLSVLADKTGYDSSMIEMDMDLESELGVDSIKRVEIMSEVQTLLSVEVSDVDALSRTKTVGDVIEAMKLELGESSSIETLNCTEVEHTSYKSVKASGCENVDTRFAKVVQISLPSKLKSTVSHDRPVIVVDDGTPLTTELCKILGGNIVVLSYQGKPAGPRGVEVPDLSEEALIQALALIRSTYGVPIGFICQQVSNVSTKAQLCWALLAAKHLKKDLNAVLPDSRSFFVGVVRLNGKLGTFENISDFSKFDLTKALDYGQRGSLLGLCKSLDLEWEQVFCRGIDLACDLMPLQAARILRNELQCPNMRLREVGYDISGARYTISTDDLLCGPSKAKVEAADLFLVTGGARGITPHCVREIASRSPGTTFVLVGRSEMSDEPDWAVGHYNKDLDQSTMKHLKATHAAGGVKPTPKAHRALVNRVTGSREVRESLRAIQEAGANVEYIACDVSDENKVRQLVQRVEQKYGCEITGIWHASGVLRDKLVEQKTTDDFEAVFGTKVTGLVNIVSQVNMSKLRHFILFSSLAGFHGNKGQTDYAIANEALNKIAHTLSAFLPKLNAKVLDFGPWVGSGMVTETLEKHFKAMGVQTIPLEPGARTVAQIILASSPPQSLLGNWGFPATKPLQRSNVVTGTLSPEEIEFIADHKIQGRKVLPMMAAIGFMASIAEGLYPGYNLQGVENAQLFQGLTINQETKFQITLIEEHNSEENLDVLTSLGVMLESGKVLPAYRCVVCLNTTQQQPKLSPKILNLEVDPACEVNPYDGKSLFHGPLLQFVQQVLHSSTKGLVAKCRALPIKEAIRGPFIKQTLHDPILDDVIFQLMLVWCRNALGSASLPNRIEKMSYFGNVSEGSTFFASVTPVGPRVPKDPVIKMQFLLQDESGNTFSSGEGSVVLSDELVF

SEQ ID NO: 40 - DNA, 1500 bp, Thraustochytrium sp.
  CDS (1)..(1500)
atgaaggacatggaagatagacgggtcgctattgtgggcatgtcagctcacttgccttgtgggacagatgtgaaggaatcatggcaggctattcgcgatggaatcgactgtctaagtgacctacccgcggatcgtctcgacgttacagcttactacaatcccaacaaagccacgaaagacaagatctactgcaaacggggtggcttcatcccgaactatgacttcgacccccgcgaatttgggctcaacatgtttcaaatggaagactctgatgcgaatcagacacttaccttgctcaaagtcaaacaagctctcgaagatgcaagcatagagcctttcaccaaggagaagaagaacattggatgtgttttaggtattggtgggggccaaaaggcgagtcatgagttctactctcgtctcaactacgttgtcgttgaaaaggtacttcggaaaatgggtttaccagatgctgatgttgaagaagctgtggagaaatacaaggcaaattttcccgagtggcgcctagactctttccctgggtttcttgggaatgtaacggctggtcggtgcagtaacaccttcaacatggaaggtatgaactgcgttgtggatgctgcatgtgccagttctctaattgcaatcaaggttgcagttgaagagctactctttggtgactgtgacaccatgattgcaggtgccacctgcacggacaattcacttggcatgtacatggccttctctaaaacgccagttttttctactgacccaagtgtccgcgcgtatgatgagaaaacaaaagggatgctaattggagaaggttcagcaatgttcgttcttaaacgctatgcggatgccgtacgtgatggcgacacaattcacgcggttctgcgttcttgctcttcgtctagtgatggaaaagcggcaggaatttatactcctactatatctggacaagaagaagctttgcgtcgagcgtatgcccgtgcgggggtatgtccatctacgatcgggcttgttgagggtcacgggacagggacccctgttggagatcgcattgagttaacagctctgcggaacttgtttgacaaagcttttggtagcaagaaggaacaaatagcagttggcagcataaagtctcagataggtcacctgaaatctgttgccggctttgccggcttggtcaaagctgtgcttgcgcttaaacacaaaacgctcccaggttcgattaatgtcgaccagccacctttgttgtatgacggtactcaaattcaagactcttctttatatatcaacaagacaaatagaccatggtttacgcaaaacaagcttccgcgtcgggctggtgtctcaagttttggatttggaggtgcaaactaccacgcggttctggaagaattcgagcccgagcatgaaaaaccataccgcctcaatactgttggacatcctgtcctcttgtacgctccgtctgtggaagccctcaaagtactttgcaacgaccag

SEQ ID NO: 41 - protein, 500 aa, Thraustochytrium sp.
MKDMEDRRVAIVGMSAHLPCGTDVKESWQAIRDGIDCLSDLPADRLDVTAYYNPNKATKDKIYCKRGGFIPNYDFDPREFGLNMFQMEDSDANQTLTLLKVKQALEDASIEPFTKEKKNIGCVLGIGGGQKASHEFYSRLNYVVVEKVLRKMGLPDADVEEAVEKYKANFPEWRLDSFPGFLGNVTAGRCSNTFNMEGMNCVVDAACASSLIAIKVAVEELLFGDCDTMIAGATCTDNSLGMYMAFSKTPVFSTDPSVRAYDEKTKGMLIGEGSAMFVLKRYADAVRDGDTIHAVLRSCSSSSDGKAAGIYTPTISGQEEALRRAYARAGVCPSTIGLVEGHGTGTPVGDRIELTALRNLFDKAFGSKKEQIAVGSIKSQIGHLKSVAGFAGLVKAVLALKHKTLPGSINVDQPPLLYDGTQIQDSSLYINKTNRPWFTQNKLPRRAGVSSFGFGGANYHAVLEEFEPEHEKPYRLNTVGHPVLLYAPSVEALKVLCNDQ

SEQ ID NO: 42 - DNA, 1500 bp, Thraustochytrium sp.
  CDS (1)..(1500)
cttgcggagctcacaattgcattggaagaggcaaaaacacataaaaatgttgacaaagtttgtggctacaagtttattgacgaatttcagctccaaggaagctgtcctccagaaaatccgagagtaggatttttagcaacactgcctacttcaaatatcattgtcgcgcttaaggcaattctcgcgcagcttgatgcaaaaccagatgcgaagaaatgggatttgcctcataaaaaggcttttggggctaccttcgcatcgtcttcagtgaaaggctctgttgctgcgctcttcgcaggacagggtacccagtacttaaacatgttctctgatgtggcaatgaactggccaccgttccgtgacagcattgtcgcaatggaagaagctcaaactgaggtatttgagggccaagttgaaccaattagcaaagttctgtttccacgagagcgctatgcatccgaaagtgaacaggggaatgaacttctttgcttaacagagtactctcagccaactacgatagcagccgcagtaggggccttcgatattttcaaagcggctggctttaagccagacatggttggagggcattcacttggcgaatttgctgctttgtacgcggctgggtccatttcgcgtgacgacctgtacaagcttgtgtgcaaacgggcaaaggcaatggcgaacgctagtgacggagctatggcagcagtgattggcccagatgcacgtctagttacgccacaaaatagtgacgtttatgtcgcaaacttcaactccgcaactcaagtagtcatcagtggcactgttcaaggtgtgaaagaagagtcgaaattgctcatttcaaaggggttccgcgtactgccacttaaatgccagggcgccttccattctcctttgatggggccttctgaggatagtttcaaatcacttgtggagacttgtaccatctcgccgccaaaaaatgtgaaattcttttgcaatgttagtggcaaggaaagcccaaacccaaaacagaccctcaagtcacacatgacgtctagcgttcagttcgaggagcagattcgtaacatgtacgatgccggagcacgtgtttttctggagtttggaccccgccaagtccttgcaaagcttatcgcggaaatgtttccctcgtgtacagctatcagcgttaaccccgcgagcagtggtgacagtgacgtgcaactccgcctcgccgccgtaaaattcgcggtctcgggtgcagcccttagcacctttgatccatgggagtatcgcaagccacaagatcttcttattcgaaaaccacgaaaaactgcccttgttctatcagcagcaacatatgtttccccaaagactcttgcagaacgtaaaaaggctatggaagatatcaagctagtatccattacaccaagagatagtatggtatcaattggaaaaatcgcgcaagaagtacggacagctaaacagcctttagaaaccgaaattcgaagactcaacaaa

SEQ ID NO: 43 - protein, 500 aa, Thraustochytrium sp.
LAELTIALEEAKTHKNVDKVCGYKFIDEFQLQGSCPPENPRVGFLATLPTSNIIVALKAILAQLDAKPDAKKWDLPHKKAFGATFASSSVKGSVAALFAGQGTQYLNMFSDVAMNWPPFRDSIVAMEEAQTEVFEGQVEPISKVLFPRERYASESEQGNELLCLTEYSQPTTIAAAVGAFDIFKAAGFKPDMVGGHSLGEFAALYAAGSISRDDLYKLVCKRAKAMANASDGAMAAVIGPDARLVTPQNSDVYVANFNSATQVVISGTVQGVKEESKLLISKGFRVLPLKCQGAFHSPLMGPSEDSFKSLVETCTISPPKNVKFFCNVSGKESPNPKQTLKSHMTSSVQFEEQIRNMYDAGARVFLEFGPRQVLAKLIAEMFPSCTAISVNPASSGDSDVQLRLAAVKFAVSGAALSTFDPWEYRKPQDLLIRKPRKTALVLSAATYVSPKTLAERKKAMEDIKLVSITPRDSMVSIGKIAQEVRTAKQPLETEIRRLNK

SEQ ID NO: 44 - DNA, 351 bp, Thraustochytrium sp.
  CDS (1)..(351)
tcgaccccagcgtcagagcggtcggcttcaccgcttttcgagaaacgcagttcggtttcgtcagcacgcctcgctgaagctgaagccgcggtactgagcgttctcgcagacaagacaggctacgacagctcaatgatcgagatggacatggacctggagagtgagcttggcgttgatagcatcaaacgcgtggagatcatgagcgaggttcaaacgctgctcagcgtggaagtctccgacgttgacgctctgtcaagaaccaagactgttggcgacgtcatcgaggcgatgaagctggaactcggtggaccccaaggccagactttgaccgcggaatcgatccgtcagcca

SEQ ID NO: 45 - protein, 117 aa, Thraustochytrium sp.
STPASERSASPLFEKRSSVSSARLAEAEAAVLSVLADKTGYDSSMIEMDMDLESELGVDSIKRVEIMSEVQTLLSVEVSDVDALSRTKTVGDVIEAMKLELGGPQGQTLTAESIRQP

SEQ ID NO: 46 - protein, 5 aa, Thraustochytrium sp.
  MISC_FEATURE (1)..(5): Xaa = any amino acid
LGXDS

SEQ ID NO: 47 - DNA, 2790 bp, Thraustochytrium sp.
  CDS (1)..(2790)
tcgaccccagcgtcagagcggtcggcttcaccgcttttcgagaaacgcagttcggtttcgtcagcacgcctcgctgaagctgaagccgcggtactgagcgttctcgcagacaagacaggctacgacagctcaatgatcgagatggacatggacctggagagtgagcttggcgttgatagcatcaaacgcgtggagatcatgagcgaggttcaaacgctgctcagcgtggaagtctccgacgttgacgctctgtcaagaaccaagactgttggcgacgtcatcgaggcgatgaagctggaactcggtggaccccaaggccagactttgaccgcggaatcgatccgtcagccaccggtgtccgagcctgctgtaccgacctcatcgtcaagcagtattgctaatgtttcgtcagcacgcctcgctgaagctgaagctgcggtactgagcgttctcgcagacaagacaggctacgacagctcaatgatcgagatggacatggacctggagagcgagcttggcgttgatagcatcaaacgcgtggagatcatgagcgaggttcaaacgctgctcagcgtggaagtctccgacgttgacgctctgtcaagaactaagactgttggcgacgtcatcgaggcgatgaagctggaactcggtggaccccaaggccagactttgaccgcggaatcgatccgtcagccaccggtgtctgagcctgctgtaccgacctcatcgtcaagcagtattgctaatgtttcgtcagcacgcctcgctgaagctgaagcggcggtactgagcgttctcgcagacaagacaggctacgacagctcaatgatcgagatggacatggacctggagagcgagcttggcgtcgacagcatcaaacgcgtggagatcatgagcgaggttcaaacgctgctcagcgtggaagtctccgacgttgacgctctgtcaagaaccaagactgttggcgacgtcatcgaggcgatgaagctggaactcggtggaccccaaggccagactttgaccgcggaatcgatccgtcagccaccggtgtccgagcctgctgtaccgacctcatcgtcaagcagtattgctaatgttttgtcagcacgcctcgctgaagctgaagccgcggtactgagcgttctcgcagacaagacaggctacgacagctcaatgatcgagatggacatggacctggagagcgagcttggcgttgatagcatcaaacgcgtggagatcatgagcgaggttcaaacgttgctcagcgtggaagtctccgacgttgacgctctgtcaagaaccaagactgttggcgacgtcatcgaggcgatgaagctggaactcggtggaccccaaggccagactttgaccgcggaatcgatccgtcagccaccggtgtctgagcctgctgtaccgacctcatcgtcaagcagtattgctaatgtttcgtcagcacgcctcgctgaagctgaagccgcggtactgagcgttctcgcagacaagacaggctacgacagctcaatgatcgagatggacatggacctggagagtgagcttggcgtcgacagcatcaaacgcgtggagatcatgagcgaggttcaaacgctgctcagcgtggaagtctccgacgttgacgctctgtcaagaaccaagactgttggcgacgtcatcgaggcgatgaagctggaactcggtggaccccaaggccagactttgacctctgaaccgatccatcagccaccagtgtccgagcctgctgtaccgacctcatcgtcaagcagtattgctaatgtttcttcagcacgcctcgctgaagctgaagccgcggtactgagcgttctcgcagacaagacaggctacgacagctcaatgatcgagatggacatggacctggagagcgagcttggcgttgatagcatcaaacgcgtggaaatcatgagcgaggttcaaacgctgctcagcgtggaagtctccgacgttgacgctctgtcaagaaccaagactgttggcgacgtcatcgaggcgatgaagatggaactcggtggaccccaaggccagactttgaccgcggaatcgatccgtcagccaccggtgtctgagcctgctgtaccgacctcatcgtcaagcagtattgctaatgtttcgtcagcacgcctcgctgaagctgaagcggcggtactgagcgttctcgcagacaagacaggctacgacagctcaatgatcgagatggacatggacctggagagcgagcttggcgttgatagcatcaaacgcgtggagatcatgagcgaggttcaagcgctgctcagcgtggaagtctccgacgttgacgctctgtcaagaaccaagactgttggcgacgtcatcgaggcgatgaagatggaactcggtggaccccaaggccagactttgaccgcagaatcgatccgtgagccaccggtgtctgagcctgctgtaccgacctcatcgtcaagtagtatcgctaatgtttcttcagctcgcctcgctgaagctgaagccgcggtactgagcgttctcgcagacaagacaggctacgacagctcaatgatcgagatggacatggacctggagagtgagcttggcgtcgacagcatcaaacgcgtggagatcatgagcgaggttcaaacgttgctcagcgtggaagtctccgacgttgacgctctgtcaagaaccaagactgttggcgacgtcatcgaggcgatgaagctggaacttggggaatcatcaagtattgagactctcaattgtaccgaggttgagcacacg

SEQ ID NO: 48 - protein, 930 aa, Thraustochytrium sp.
STPASERSASPLFEKRSSVSSARLAEAEAAVLSVLADKTGYDSSMIEMDMDLESELGVDSIKRVEIMSEVQTLLSVEVSDVDALSRTKTVGDVIEAMKLELGGPQGQTLTAESIRQPPVSEPAVPTSSSSSIANVSSARLAEAEAAVLSVLADKTGYDSSMIEMDMDLESELGVDSIKRVEIMSEVQTLLSVEVSDVDALSRTKTVGDVIEAMKLELGGPQGQTLTAESIRQPPVSEPAVPTSSSSSIANVSSARLAEAEAAVLSVLADKTGYDSSMIEMDMDLESELGVDSIKRVEIMSEVQTLLSVEVSDVDALSRTKTVGDVIEAMKLELGGPQGQTLTAESIRQPPVSEPAVPTSSSSSIANVLSARLAEAEAAVLSVLADKTGYDSSMIEMDMDLESELGVDSIKRVEIMSEVQTLLSVEVSDVDALSRTKTVGDVIEAMKLELGGPQGQTLTAESIRQPPVSEPAVPTSSSSSIANVSSARLAEAEAAVLSVLADKTGYDSSMIEMDMDLESELGVDSIKRVEIMSEVQTLLSVEVSDVDALSRTKTVGDVIEAMKLELGGPQGQTLTSEPIHQPPVSEPAVPTSSSSSIANVSSARLAEAEAAVLSVLADKTGYDSSMIEMDMDLESELGVDSIKRVEIMSEVQTLLSVEVSDVDALSRTKTVGDVIEAMKMELGGPQGQTLTAESIRQPPVSEPAVPTSSSSSIANVSSARLAEAEAAVLSVLADKTGYDSSMIEMDMDLESELGVDSIKRVEIMSEVQALLSVEVSDVDALSRTKTVGDVIEAMKMELGGPQGQTLTAESIREPPVSEPAVPTSSSSSIANVSSARLAEAEAAVLSVLADKTGYDSSMIEMDMDLESELGVDSIKRVEIMSEVQTLLSVEVSDVDALSRTKTVGDVIEAMKLELGESSSIETLNCTEVEHT

SEQ ID NO: 49 - DNA, 2433 bp, Thraustochytrium sp.
  CDS (1)..(2433)
aaaagtgtcaaggcttcagggtgtgagaatgtagatacccgtttcgctaaggttgtacaaatctcgcttcctagcaagctgaaatccactgtgtcgcacgatcgacctgtaattgttgtagatgatggaacgcccttaaccacggagctttgtaaaattcttgggggtaatattgtggttctctcttatcaagggaagcccgctggtccacggggagtcgaggtgccagatctttccgaggaagccctaattcaagctcttgcattgattcggtctacatatggagttccaattggttttatttgtcagcaagtgtctaatgtgagcaccaaggcacagctttgttgggcactcctcgcagcgaagcatctcaagaaggatttgaatgctgtcttacccgattcaagatccttcttcgtcggagttgtacgcttgaacgggaaacttggaactttcgaaaacatcagcgacttctctaaatttgatttgacgaaagccctagattacggacagcgtggttctctcttaggcctgtgcaagtcactagacttagaatgggaacaggtgttttgccgtggaatagatcttgcgtgtgatcttatgccactccaggccgcaaggatactcagaaatgagcttcagtgtcccaatatgcgccttcgcgaggttgggtacgatatttctggcgccaggtacaccatttcaaccgatgacctgctatgtggaccctcgaaggctaaagtagaggccgcagacttgtttcttgtgacaggtggcgcacgaggtattacacctcattgtgttcgtgagattgcaagtcgatcccccggaaccacatttgtgctggttggaagaagcgaaatgtccgacgagcctgactgggctgttggccactacaataaagacctggaccaaagcacaatgaaacacttgaaagcaacgcatgctgctggaggggtaaaacctacgcctaaagcacatcgtgcacttgtgaacagggtcactggctcacgggaggtacgagaatctcttagagcaatccaggaggcaggggcaaatgtcgaatatatcgcctgtgatgtttcggatgaaaacaaggtccgccaacttgtgcaaagagtggagcaaaagtatggctgtgaaataactgggatttggcatgcaagcggggttcttcgtgacaaacttgtcgagcaaaagactacagacgactttgaggcagtttttgggaccaaggtgactggccttgtaaacatcgtgtcacaagtcaatatgtctaagctacgacacttcatcctcttcagttctttggctggatttcatgggaacaagggccaaacggattatgcaattgctaatgaagccttgaacaaaatcgcgcatactctctcagcgtttttgcccaaactgaatgcaaaggtgctagacttcggtccgtgggtaggttcaggaatggtaaccgaaacacttgagaagcattttaaagctatgggggttcagactattcctctcgagccaggagcacggactgttgcgcaaatcattttggcaagttcgccaccgcaatcgcttttggggaactggggctttccagccaccaaaccgctacaacgctctaatgtagtcacgggcacactctctccggaagagatagaattcatcgcagaccacaaaattcaaggccgcaaggtgcttcccatgatggctgcaatcgggttcatggcctctattgcggaaggactctacccggggtacaatctgcaaggcgtggaaaatgctcagctctttcaaggcttgactatcaaccaagagacaaaatttcaaatcactctcattgaggagcacaactctgaggaaaacctggatgtcctgacatcccttggtgtaatgttggaaagcgggaaggtgcttcccgcttaccgatgtgttgtatgcttgaatacaacccagcagcagcccaagctatctccaaaaattcttaacttggaagttgaccctgcatgcgaggttaacccctatgatggaaagtcgttgttccacggtccgcttttgcaattcgttcaacaagtgttgcactcaagtaccaaaggcctcgttgccaagtgccgcgcgcttccaatcaaagaagccatccgagggccatttatcaagcaaacactccatgatccaattctagacgacgtcatttttcagctaatgctcgtgtggtgtcgtaatgctctaggaagtgcatcgctacccaacagaattgaaaagatgtcatactttgggaatgtctcagaaggtagcactttctttgcctcagttacacctgtgggaccaagagtaccaaaggatcccgtgatcaaaatgcagtttcttctccaagatgaatccggcaacacattttcatcgggggagggctcggttgtgcttagtgacgaactcgtcttt

SEQ ID NO: 50 - protein, 811 aa, Thraustochytrium sp.
KSVKASGCENVDTRFAKVVQISLPSKLKSTVSHDRPVIVVDDGTPLTTELCKILGGNIVVLSYQGKPAGPRGVEVPDLSEEALIQALALIRSTYGVPIGFICQQVSNVSTKAQLCWALLAAKHLKKDLNAVLPDSRSFFVGVVRLNGKLGTFENISDFSKFDLTKALDYGQRGSLLGLCKSLDLEWEQVFCRGIDLACDLMPLQAARILRNELQCPNMRLREVGYDISGARYTISTDDLLCGPSKAKVEAADLFLVTGGARGITPHCVREIASRSPGTTFVLVGRSEMSDEPDWAVGHYNKDLDQSTMKHLKATHAAGGVKPTPKAHRALVNRVTGSREVRESLRAIQEAGANVEYIACDVSDENKVRQLVQRVEQKYGCEITGIWHASGVLRDKLVEQKTTDDFEAVFGTKVTGLVNIVSQVNMSKLRHFILFSSLAGFHGNKGQTDYAIANEALNKIAHTLSAFLPKLNAKVLDFGPWVGSGMVTETLEKHFKAMGVQTIPLEPGARTVAQIILASSPPQSLLGNWGFPATKPLQRSNVVTGTLSPEEIEFIADHKIQGRKVLPMMAAIGFMASIAEGLYPGYNLQGVENAQLFQGLTINQETKFQITLIEEHNSEENLDVLTSLGVMLESGKVLPAYRCVVCLNTTQQQPKLSPKILNLEVDPACEVNPYDGKSLFHGPLLQFVQQVLHSSTKGLVAKCRALPIKEAIRGPFIKQTLHDPILDDVIFQLMLVWCRNALGSASLPNRIEKMSYFGNVSEGSTFFASVTPVGPRVPKDPVIKMQFLLQDESGNTFSSGEGSVVLSDELVF

SEQ ID NO: 51 - DNA, 5808 bp, Thraustochytrium sp.
  CDS (1)..(5805)
  misc_feature (1)..(5808): n = a c t or g
atgcaacttcctccagcgcattctgccgatgagaatcgcatcgcggtcgtgggcatggccgtcaaatatgcgggctgtgacaataaagaagagttttggaagactttgatgaatggtagtatcaataccaagtcgatttcggcagcaaggttgggcagcaataagcgtgacgaacactatgttcctgaacgatcgaaatatgcagatacgttctgtaacgaaaggtacggttgtatccagcaaggtacggataatgagcatgacctcctcctaggtcttgctcaagaagctctcgctgacgctgccgggcggatggagaaacaaccttcggaggcgttcgatctggaaaatactggcatcgtgagtgggtgcttatcttttccaatggataacctgcaaggagagttgttgaacttgtatcaaagccatgtggagaaacaacttccacctagtgccttggtagaagccgtgaagctttggtctgagcgacagaaatctacgaaagcacatgcaggggacaagcgccggttcattgacccagcttcttttgtagctgataaactgaacctaggcccactacattatgcgatcgatgcagcatgcgcttctgcattgtacgtgttaaaattagctcaagaccaccttgtttcaggtgccgttgatatgatgttatgtggagcgacgtgcttcccagaaccattcttcatcttgtctgggttctcgacttttcaagcgatgcctgntggggcagatggagtctcactacctctccataaaacgagtgctgggctcactccaggtgaaggggggtccattatggtgctcaagcgactgaaagacgctatcagagatggaaatcacatttatggtgtgctccttgaagcaaatttaagtaacgcaggttgtgggcttccactcagcccgcacttaccgagcgaagaatcatgtattcgtgatacctaccgccgtgctggagttgctgcagatcaaagtattcagtatattgagtgccacgctacgggaacccctcgaggggatgtcgtggaaattgaggcggttgaaagagttttcaagaaaaacgttccacgcttaggctcgacgaaaggaaattttggtcactcgttagttgcggctggtttcgcaggtatggcaaagcttcttcttgcaatggaacatggagtgattcctcccacaccaggtcttgatgcttcgaaccaggcaagtgagcacgttgtgacaaaggctatcacttggcctgagacacatggggctccaaaacgagctggcctttcagcatttggatttggtgggactaatgcgcatgcactcttcgaagagtttaatgccgagggcataagttatcgccctggaaagcctccagtcgaatcgaatacccgtccttccgtcgtaataactgggatggactgtacctttgggagccttgaagggattgatgcgttcgagactgccctgtacgaggggcgtgacgcagctcgtgacttacccgccaaacgttggaggttcctaggtgaggacttggagtttctccgagccatcaggctcaaggaaaagcctaggggttgttttgtggagagtgttgacgttaactttagacggctgaaaacgcccttgacaccagaagatatgttgcggccccaacaactcttggcggtttctacgatggaccgagcaattatcgatgcaggtctaaagaagggccaacatgtagcagttcttgttggcctaggaactgacctggaactttaccgtcatcgagcaagagtcgcgcttaaagaggttttgcacccgagcttaaagtcagacactgcaattctccagaaaataatgcaatatgtgaatgatgcaggaacttcgacttcatacacatcttacattggaaacctcgttgccacgcgtatttcgtctcagtggggattcacagggccgtcctttactgtcacagaaggaaataattccgtgtacagatgtgcacaactagccaaagatatgcttcaggttaaccgagttgatgctgtcgtcatcgcaggcgttgatctcaacggaagcgccgaaagtttttttgtccgagcaaatcgtcaaaagatatccaagctaagtcatccatgtgcaagcttcgacagagatgcagatggatttttcgcaggtgagggctgtggtgccctagttttcaagaggttagaagactgtgctcctcaggaaaaaatttatgctagtatagactctatcgcaatagataaagagcctactagctcagctgtgaaagctgtctaccaaagtgattcgagtctctccgatattgagctgttagaaatcagtggagactccaaacggtttgcagcattcgaaggcgctgtggaaattcaatcaagtgtggaagcccagctaaaaggactttccaaagtccttgaacctgcaaaaggccaaggcgtagcggtgggaagtactcgagcaaccgttggggatatagggtatgctacaggagcggcaagcctgattaaaactgcactctgcttatataatcgctaccttccggcattagcaaactggagtggcccatgtgaacagtccgcctggggctcaaacatgttcgtttgccatgaaacacggccgtggatgaaaaaccagaatgaaaagagatgtgccctcatttctggaacagatccatctcatacatgcttttccctcgtactatcggatactgggtgttatgaagagcacaatcgaacgtgctttgatgtgcaagcgccacagctagttctgatacacggattcgatggaaaaactattgtgcggcgacttgaaggatatctccttgaacttgttgaagggcatgcaagcccttcagagtatttccacaaactgattggacaaagtctacttgagaactcgaaagaaagtaaactcacactttcgcttgtgtgcaatccgaaccagctccaaaaggagctcatgcttgctatcaaaggagtacaacgaagcatgttaacagggaaggattgggtcagtccatcaggaagttgttttgccccaaatccgttatcaagcgcaaaagtggcattcatgtacggagaaggccgaagcccgtactgtggtgtaggcttgggtctacatcgtttgtggcccggtctccatgaaaatgtgaacaataagacagtcgatttatggacggaaggagatggttggttatatcctcgaacgttgacacgagaagagcatacaaaagccatcgaatctttcaacgcaaatcaaattgaaatgtttcgcgctgggattttcatctcaatgtgtcagacagactatgtcatgaatgttctcggtgtccagcctaaggccggatttgggctgagcttgggagaaatttcaatgctctttgcgatgtcaaaggagaactgcaggcagtcacaggaaatgaccaatcgtttgcgcggttctccagtgtggtctaacgagcttgctatcaacttcaatgcaattcgcaagttatggaaaatcccccgaggagctcccttagaatccttttggcaaggatacttggttcacggcacaagagaagaagtagagcatgctattggtctttctgagccttatgtacgtctgcttattgtgaacgattcaaggagtgccttgattgctggaaaaccagacgcctgtcaggcagtaatcagtagactaaactccaagttcccttctctgccggtaaagcaaggaatgattggtcattgcccagaagttcgtgcgttcatcaaagatattgggtacatccatgaaacactccgaatttccaatgactattcggattgtcagcttttctcagcggtaaccaagggcgcacttgacagctccacaatggaaatcaaacactttgtgggagaggtctactcccggatcgcagactttcctcaaatcgtcaacacggtgcattcggctggttatgacgtatttcttgagcttggctgtgatgcttctagatctgcagcagttcaaaacattcttggtggtcaaggaaagttcttgtctacagctattgacaaaaaaggacactccgcctggtcacaagtacttcgggctaccgcatcattagctgcacatcgagtaccgggaatctcaattttggatttgtttcacccaaatttccgagaaatgtgctgtacaatggcaaccacacctaaagtggaagataagttcctgcgcacgattcaaatcaatggtcggtttgaaaaagaaatgattcacctagaagatacaacattaagttgcttacccgctccaagtgaagcaaatatcgcagctattcaatctcggtcaattcgatctgctgcggcgcgttctggacaatcccatgattgtgcatcccatagccatgaagaaaataaggattcatgccctgaaaagctgaagcttgattctgtgtccgtcgccataaatttcgacaatgatgaccgcattcagcttgggcacgcgggttttcgggagatgtacaatacaagatatagcttgtacacaggggcgatggcaaagggaattgcatctgcagatcttgtcattgccgctgggaaagagggcatcctagcttcctatggagctggaggactacctcttgctactgttcgaaagggaatagacaaaattcaacaagccttgccaagtggcccatatgctgtaaatcttattcactctccctttgacggcaacttggagcagggaaacgtcgatttgttcttggaaaagaacgtccgcgtggcggaatgttccgcgtttacaacgctaacagtgccagtagtacactatcgtgctgcagggcttgttcggcgccaagatggaagcattttgatcaagaaccgaatcattgctaaagtatctaggacagaactcgctgagatgttccttcgtccggcacctcaaatcatcctcgaaaaactggtagcagcagaaatcatttcatctgaccaagcgcgtatggcagccaaagttcccatggcggacgacatcgcagtcgaagccgactctggtgggcacacggataatcggcctatgcacgtcattttgcccctgataattcaactccgcaatactatacttgcagagtatggctgtgccacggcttttcgtacccgtataggcgctggaggaggcattggttgtccttcagcggccctcgcagcctttgatatgggtgcgagttttgtcgtgactggaagcataaatcaaatttgccgcgaggcagggacttgcgatactgttcgggagctacttgccaactcaagctactcggacgtgacgatggcgccagcagcagacatgtttgaccaaggtgtgaaactccaagtcttaaaacgaggaacgatgtttccaagcagagcaaataaactccggaagctctttgtgaactacgaatctctagaaacactcccgtcgaaagagttgaaatacctggaaaacatcatattcaagcaagcagtagaccaggtgtgggaggaaacaaagcgcttttactgtgaaaaactgaacaatccagataaaattgcaagggccatgaaagatcctaaattgaagatgtcgctttgctttcggtggtatctctccaagagctctgggtgggccaacgcaggaattaaatctcgtgcactcgactaccagatctggtgtggcccggcaatgggctcgttcaacaatttcgccagcggcacatccctcgattggaaagtgactggggttttccctggcgttgcggaagtaaacatggccattttagatggcgcgcgagaactagctgctaaacgaaattaa

SEQ ID NO: 52 - protein, 1935 aa, Thraustochytrium sp.
  misc_feature (248)..(248): The 'Xaa' at location 248 stands for Asp, Gly, Ala, or Val.
MQLPPAHSADENRIAVVGMAVKYAGCDNKEEFWKTLMNGSINTKSISAARLGSNKRDEHYVPERSKYADTFCNERYGCIQQGTDNEHDLLLGLAQEALADAAGRMEKQPSEAFDLENTGIVSGCLSFPMDNLQGELLNLYQSHVEKQLPPSALVEAVKLWSERQKSTKAHAGDKRRFIDPASFVADKLNLGPLHYAIDAACASALYVLKLAQDHLVSGAVDMMLCGATCFPEPFFILSGFSTFQAMPXGADGVSLPLHKTSAGLTPGEGGSIMVLKRLKDAIRDGNHIYGVLLEANLSNAGCGLPLSPHLPSEESCIRDTYRRAGVAADQSIQYIECHATGTPRGDVVEIEAVERVFKKNVPRLGSTKGNFGHSLVAAGFAGMAKLLLAMEHGVIPPTPGLDASNQASEHVVTKAITWPETHGAPKRAGLSAFGFGGTNAHALFEEFNAEGISYRPGKPPVESNTRPSVVITGMDCTFGSLEGIDAFETALYEGRDAARDLPAKRWRFLGEDLEFLRAIRLKEKPRGCFVESVDVNFRRLKTPLTPEDMLRPQQLLAVSTMDRAIIDAGLKKGQHVAVLVGLGTDLELYRHRARVALKEVLHPSLKSDTAILQKIMQYVNDAGTSTSYTSYIGNLVATRISSQWGFTGPSFTVTEGNNSVYRCAQLAKDMLQVNRVDAVVIAGVDLNGSAESFFVRANRQKISKLSHPCASFDRDADGFFAGEGCGALVFKRLEDCAPQEKIYASIDSIAIDKEPTSSAVKAVYQSDSSLSDIELLEISGDSKRFAAFEGAVEIQSSVEAQLKGLSKVLEPAKGQGVAVGSTRATVGDIGYATGAASLIKTALCLYNRYLPALANWSGPCEQSAWGSNMFVCHETRPWMKNQNEKRCALISGTDPSHTCFSLVLSDTGCYEEHNRTCFDVQAPQLVLIHGFDGKTIVRRLEGYLLELVEGHASPSEYFHKLIGQSLLENSKESKLTLSLVCNPNQLQKELMLAIKGVQRSMLTGKDWVSPSGSCFAPNPLSSAKVAFMYGEGRSPYCGVGLGLHRLWPGLHENVNNKTVDLWTEGDGWLYPRTLTREEHTKAIESFNANQIEMFRAGIFISMCQTDYVMNVLGVQPKAGFGLSLGEISMLFAMSKENCRQSQEMTNRLRGSPVWSNELAINFNAIRKLWKIPRGAPLESFWQGYLVHGTREEVEHAIGLSEPYVRLLIVNDSRSALIAGKPDACQAVISRLNSKFPSLPVKQGMIGHCPEVRAFIKDIGYIHETLRISNDYSDCQLFSAVTKGALDSSTMEIKHFVGEVYSRIADFPQIVNTVHSAGYDVFLELGCDASRSAAVQNILGGQGKFLSTAIDKKGHSAWSQVLRATASLAAHRVPGISILDLFHPNFREMCCTMATTPKVEDKFLRTIQINGRFEKEMIHLEDTTLSCLPAPSEANIAAIQSRSIRSAAARSGQSHDCASHSHEENKDSCPEKLKLDSVSVAINFDNDDRIQLGHAGFREMYNTRYSLYTGAMAKGIASADLVIAAGKEGILASYGAGGLPLATVRKGIDKIQQALPSGPYAVNLIHSPFDGNLEQGNVDLFLEKNVRVAECSAFTTLTVPVVHYRAAGLVRRQDGSILIKNRIIAKVSRTELAEMFLRPAPQIILEKLVAAEIISSDQARMAAKVPMADDIAVEADSGGHTDNRPMHVILPLIIQLRNTILAEYGCATAFRTRIGAGGGIGCPSAALAAFDMGASFVVTGSINQICREAGTCDTVRELLANSSYSDVTMAPAADMFDQGVKLQVLKRGTMFPSRANKLRKLFVNYESLETLPSKELKYLENIIFKQAVDQVWEETKRFYCEKLNNPDKIARAMKDPKLKMSLCFRWYLSKSSGWANAGIKSRALDYQIWCGPAMGSFNNFASGTSLDWKVTGVFPGVAEVNMAILDGARELAAKRN

SEQ ID NO: 53 - DNA, 1500 bp, Thraustochytrium sp.
  CDS (1)..(1500)
  misc_feature (1)..(1500): n = a c t or g
atgcaacttcctccagcgcattctgccgatgagaatcgcatcgcggtcgtgggcatggccgtcaaatatgcgggctgtgacaataaagaagagttttggaagactttgatgaatggtagtatcaataccaagtcgatttcggcagcaaggttgggcagcaataagcgtgacgaacactatgttcctgaacgatcgaaatatgcagatacgttctgtaacgaaaggtacggttgtatccagcaaggtacggataatgagcatgacctcctcctaggtcttgctcaagaagctctcgctgacgctgccgggcggatggagaaacaaccttcggaggcgttcgatctggaaaatactggcatcgtgagtgggtgcttatcttttccaatggataacctgcaaggagagttgttgaacttgtatcaaagccatgtggagaaacaacttccacctagtgccttggtagaagccgtgaagctttggtctgagcgacagaaatctacgaaagcacatgcaggggacaagcgccggttcattgacccagcttcttttgtagctgataaactgaacctaggcccactacattatgcgatcgatgcagcatgcgcttctgcattgtacgtgttaaaattagctcaagaccaccttgtttcaggtgccgttgatatgatgttatgtggagcgacgtgcttcccagaaccattcttcatcttgtctgggttctcgacttttcaagcgatgcctgntggggcagatggagtctcactacctctccataaaacgagtgctgggctcactccaggtgaaggggggtccattatggtgctcaagcgactgaaagacgctatcagagatggaaatcacatttatggtgtgctccttgaagcaaatttaagtaacgcaggttgtgggcttccactcagcccgcacttaccgagcgaagaatcatgtattcgtgatacctaccgccgtgctggagttgctgcagatcaaagtattcagtatattgagtgccacgctacgggaacccctcgaggggatgtcgtggaaattgaggcggttgaaagagttttcaagaaaaacgttccacgcttaggctcgacgaaaggaaattttggtcactcgttagttgcggctggtttcgcaggtatggcaaagcttcttcttgcaatggaacatggagtgattcctcccacaccaggtcttgatgcttcgaaccaggcaagtgagcacgttgtgacaaaggctatcacttggcctgagacacatggggctccaaaacgagctggcctttcagcatttggatttggtgggactaatgcgcatgcactcttcgaagagtttaatgccgagggcataagttatcgccctggaaagcctccagtcgaatcgaatacccgtccttccgtcgtaataactgggatggactgtacctttgggagccttgaagggattgatgcgttcgagactgccctgtacgaggggcgtgacgcagctcgtgac

SEQ ID NO: 54 - protein, 500 aa, Thraustochytrium sp.
  misc_feature (248)..(248): The 'Xaa' at location 248 stands for Asp, Gly, Ala, or Val.
MQLPPAHSADENRIAVVGMAVKYAGCDNKEEFWKTLMNGSINTKSISAARLGSNKRDEHYVPERSKYADTFCNERYGCIQQGTDNEHDLLLGLAQEALADAAGRMEKQPSEAFDLENTGIVSGCLSFPMDNLQGELLNLYQSHVEKQLPPSALVEAVKLWSERQKSTKAHAGDKRRFIDPASFVADKLNLGPLHYAIDAACASALYVLKLAQDHLVSGAVDMMLCGATCFPEPFFILSGFSTFQAMPXGADGVSLPLHKTSAGLTPGEGGSIMVLKRLKDAIRDGNHIYGVLLEANLSNAGCGLPLSPHLPSEESCIRDTYRRAGVAADQSIQYIECHATGTPRGDVVEIEAVERVFKKNVPRLGSTKGNFGHSLVAAGFAGMAKLLLAMEHGVIPPTPGLDASNQASEHVVTKAITWPETHGAPKRAGLSAFGFGGTNAHALFEEFNAEGISYRPGKPPVESNTRPSVVITGMDCTFGSLEGIDAFETALYEGRDAARD

SEQ ID NO: 55 - DNA, 1500 bp, Thraustochytrium sp.
  CDS (1)..(1500)
ttacccgccaaacgttggaggttcctaggtgaggacttggagtttctccgagccatcaggctcaaggaaaagcctaggggttgttttgtggagagtgttgacgttaactttagacggctgaaaacgcccttgacaccagaagatatgttgcggccccaacaactcttggcggtttctacgatggaccgagcaattatcgatgcaggtctaaagaagggccaacatgtagcagttcttgttggcctaggaactgacctggaactttaccgtcatcgagcaagagtcgcgcttaaagaggttttgcacccgagcttaaagtcagacactgcaattctccagaaaataatgcaatatgtgaatgatgcaggaacttcgacttcatacacatcttacattggaaacctcgttgccacgcgtatttcgtctcagtggggattcacagggccgtcctttactgtcacagaaggaaataattccgtgtacagatgtgcacaactagccaaagatatgcttcaggttaaccgagttgatgctgtcgtcatcgcaggcgttgatctcaacggaagcgccgaaagtttttttgtccgagcaaatcgtcaaaagatatccaagctaagtcatccatgtgcaagcttcgacagagatgcagatggatttttcgcaggtgagggctgtggtgccctagttttcaagaggttagaagactgtgctcctcaggaaaaaatttatgctagtatagactctatcgcaatagataaagagcctactagctcagctgtgaaagctgtctaccaaagtgattcgagtctctccgatattgagctgttagaaatcagtggagactccaaacggtttgcagcattcgaaggcgctgtggaaattcaatcaagtgtggaagcccagctaaaaggactttccaaagtccttgaacctgcaaaaggccaaggcgtagcggtgggaagtactcgagcaaccgttggggatatagggtatgctacaggagcggcaagcctgattaaaactgcactctgcttatataatcgctaccttccggcattagcaaactggagtggcccatgtgaacagtccgcctggggctcaaacatgttcgtttgccatgaaacacggccgtggatgaaaaaccagaatgaaaagagatgtgccctcatttctggaacagatccatctcatacatgcttttccctcgtactatcggatactgggtgttatgaagagcacaatcgaacgtgctttgatgtgcaagcgccacagctagttctgatacacggattcgatggaaaaactattgtgcggcgacttgaaggatatctccttgaacttgttgaagggcatgcaagcccttcagagtatttccacaaactgattggacaaagtctacttgagaactcgaaagaaagtaaactcacactttcgcttgtgtgcaatccgaaccagctccaaaaggagctcatgcttgctatcaaaggagtacaacgaagc

SEQ ID NO: 56 - protein, 500 aa, Thraustochytrium sp.
LPAKRWRFLGEDLEFLRAIRLKEKPRGCFVESVDVNFRRLKTPLTPEDMLRPQQLLAVSTMDRAIIDAGLKKGQHVAVLVGLGTDLELYRHRARVALKEVLHPSLKSDTAILQKIMQYVNDAGTSTSYTSYIGNLVATRISSQWGFTGPSFTVTEGNNSVYRCAQLAKDMLQVNRVDAVVIAGVDLNGSAESFFVRANRQKISKLSHPCASFDRDADGFFAGEGCGALVFKRLEDCAPQEKIYASIDSIAIDKEPTSSAVKAVYQSDSSLSDIELLEISGDSKRFAAFEGAVEIQSSVEAQLKGLSKVLEPAKGQGVAVGSTRATVGDIGYATGAASLIKTALCLYNRYLPALANWSGPCEQSAWGSNMFVCHETRPWMKNQNEKRCALISGTDPSHTCFSLVLSDTGCYEEHNRTCFDVQAPQLVLIHGFDGKTIVRRLEGYLLELVEGHASPSEYFHKLIGQSLLENSKESKLTLSLVCNPNQLQKELMLAIKGVQRS

SEQ ID NO: 57 - DNA, 1500 bp, Thraustochytrium sp.
  CDS (1)..(1500)
atgttaacagggaaggattgggtcagtccatcaggaagttgttttgccccaaatccgttatcaagcgcaaaagtggcattcatgtacggagaaggccgaagcccgtactgtggtgtaggcttgggtctacatcgtttgtggcccggtctccatgaaaatgtgaacaataagacagtcgatttatggacggaaggagatggttggttatatcctcgaacgttgacacgagaagagcatacaaaagccatcgaatctttcaacgcaaatcaaattgaaatgtttcgcgctgggattttcatctcaatgtgtcagacagactatgtcatgaatgttctcggtgtccagcctaaggccggatttgggctgagcttgggagaaatttcaatgctctttgcgatgtcaaaggagaactgcaggcagtcacaggaaatgaccaatcgtttgcgcggttctccagtgtggtctaacgagcttgctatcaacttcaatgcaattcgcaagttatggaaaatcccccgaggagctcccttagaatccttttggcaaggatacttggttcacggcacaagagaagaagtagagcatgctattggtctttctgagccttatgtacgtctgcttattgtgaacgattcaaggagtgccttgattgctggaaaaccagacgcctgtcaggcagtaatcagtagactaaactccaagttcccttctctgccggtaaagcaaggaatgattggtcattgcccagaagttcgtgcgttcatcaaagatattgggtacatccatgaaacactccgaatttccaatgactattcggattgtcagcttttctcagcggtaaccaagggcgcacttgacagctccacaatggaaatcaaacactttgtgggagaggtctactcccggatcgcagactttcctcaaatcgtcaacacggtgcattcggctggttatgacgtatttcttgagcttggctgtgatgcttctagatctgcagcagttcaaaacattcttggtggtcaaggaaagttcttgtctacagctattgacaaaaaaggacactccgcctggtcacaagtacttcgggctaccgcatcattagctgcacatcgagtaccgggaatctcaattttggatttgtttcacccaaatttccgagaaatgtgctgtacaatggcaaccacacctaaagtggaagataagttcctgcgcacgattcaaatcaatggtcggtttgaaaaagaaatgattcacctagaagatacaacattaagttgcttacccgctccaagtgaagcaaatatcgcagctattcaatctcggtcaattcgatctgctgcggcgcgttctggacaatcccatgattgtgcatcccatagccatgaagaaaataaggattcatgccctgaaaagctgaagcttgattctgtgtccgtcgccataaatttcgacaatgatgaccgcattcagcttgggcacgcgggttttcgggagatgtac

SEQ ID NO: 58 - protein, 500 aa, Thraustochytrium sp.
MLTGKDWVSPSGSCFAPNPLSSAKVAFMYGEGRSPYCGVGLGLHRLWPGLHENVNNKTVDLWTEGDGWLYPRTLTREEHTKAIESFNANQIEMFRAGIFISMCQTDYVMNVLGVQPKAGFGLSLGEISMLFAMSKENCRQSQEMTNRLRGSPVWSNELAINFNAIRKLWKIPRGAPLESFWQGYLVHGTREEVEHAIGLSEPYVRLLIVNDSRSALIAGKPDACQAVISRLNSKFPSLPVKQGMIGHCPEVRAFIKDIGYIHETLRISNDYSDCQLFSAVTKGALDSSTMEIKHFVGEVYSRIADFPQIVNTVHSAGYDVFLELGCDASRSAAVQNILGGQGKFLSTAIDKKGHSAWSQVLRATASLAAHRVPGISILDLFHPNFREMCCTMATTPKVEDKFLRTIQINGRFEKEMIHLEDTTLSCLPAPSEANIAAIQSRSIRSAAARSGQSHDCASHSHEENKDSCPEKLKLDSVSVAINFDNDDRIQLGHAGFREMY

SEQ ID NO: 59 - DNA, 1305 bp, Thraustochytrium sp.
  CDS (1)..(1305)
aatacaagatatagcttgtacacaggggcgatggcaaagggaattgcatctgcagatcttgtcattgccgctgggaaagagggcatcctagcttcctatggagctggaggactacctcttgctactgttcgaaagggaatagacaaaattcaacaagccttgccaagtggcccatatgctgtaaatcttattcactctccctttgacggcaacttggagcagggaaacgtcgatttgttcttggaaaagaacgtccgcgtggcggaatgttccgcgtttacaacgctaacagtgccagtagtacactatcgtgctgcagggcttgttcggcgccaagatggaagcattttgatcaagaaccgaatcattgctaaagtatctaggacagaactcgctgagatgttccttcgtccggcacctcaaatcatcctcgaaaaactggtagcagcagaaatcatttcatctgaccaagcgcgtatggcagccaaagttcccatggcggacgacatcgcagtcgaagccgactctggtgggcacacggataatcggcctatgcacgtcattttgcccctgataattcaactccgcaatactatacttgcagagtatggctgtgccacggcttttcgtacccgtataggcgctggaggaggcattggttgtccttcagcggccctcgcagcctttgatatgggtgcgagttttgtcgtgactggaagcataaatcaaatttgccgcgaggcagggacttgcgatactgttcgggagctacttgccaactcaagctactcggacgtgacgatggcgccagcagcagacatgtttgaccaaggtgtgaaactccaagtcttaaaacgaggaacgatgtttccaagcagagcaaataaactccggaagctctttgtgaactacgaatctctagaaacactcccgtcgaaagagttgaaatacctggaaaacatcatattcaagcaagcagtagaccaggtgtgggaggaaacaaagcgcttttactgtgaaaaactgaacaatccagataaaattgcaagggccatgaaagatcctaaattgaagatgtcgctttgctttcggtggtatctctccaagagctctgggtgggccaacgcaggaattaaatctcgtgcactcgactaccagatctggtgtggcccggcaatgggctcgttcaacaatttcgccagcggcacatccctcgattggaaagtgactggggttttccctggcgttgcggaagtaaacatggccattttagatggcgcgcgagaactagctgctaaacgaaat

SEQ ID NO: 60 - protein, 435 aa, Thraustochytrium sp.
NTRYSLYTGAMAKGIASADLVIAAGKEGILASYGAGGLPLATVRKGIDKIQQALPSGPYAVNLIHSPFDGNLEQGNVDLFLEKNVRVAECSAFTTLTVPVVHYRAAGLVRRQDGSILIKNRIIAKVSRTELAEMFLRPAPQIILEKLVAAEIISSDQARMAAKVPMADDIAVEADSGGHTDNRPMHVILPLIIQLRNTILAEYGCATAFRTRIGAGGGIGCPSAALAAFDMGASFVVTGSINQICREAGTCDTVRELLANSSYSDVTMAPAADMFDQGVKLQVLKRGTMFPSRANKLRKLFVNYESLETLPSKELKYLENIIFKQAVDQVWEETKRFYCEKLNNPDKIARAMKDPKLKMSLCFRWYLSKSSGWANAGIKSRALDYQIWCGPAMGSFNNFASGTSLDWKVTGVFPGVAEVNMAILDGARELAAKRN

SEQ ID NO: 61 - DNA, 4410 bp, Thraustochytrium sp.
  CDS (1)..(4410)
atgggcccgcgagtggcgtcaggcaaggtgccggcttgggagatgagcaagtccgagctgtgtgatgaccgcacggtagtctttgactatgaggagctgctggagttcgctgagggcgatatcagtaaggtttttgggccggagttcaaagtggtggacgggtttaggcgcagggtgaggttgcccgctcgagagtacctgctggtgacccgggttacgctgatggatgccgaggtgggcaactttcgagtgggagcacgtatggtgacagagtatgacgtacctgtgaacggagagctctcggaagggggagatgtgccgtgggctgtgttggtggaagccgggcagtgcgacttgctgctaatttcttacatgggcatcgatttccagtgcaaaggagagcgggtctaccggctgctgaacaccaccttgacgttttttggcgtcgcgaaagaaggggaaacgcttgtgtacgatattcgcgtcacgggtttcgccaagaggccggacggagatatctccatgttctttttcgaatatgattgctactgcaatggcaagcttctcatcgaaatgcgagatggctctgcaggcttcttcacggacgaagagctcgctgccggcaaaggagtggtcgtcactcgtgcacagcaaaacatgcgggacaaaattgtacggcagtccattgagccttttgcactggcggcttgcacgcacaaaacgactctgaacgagagtgacatgcagtcccttgtggagcgaaactgggcaaacgtttttggcaccagtaacaagatggcggagctcaactataaaatttgcgccaggaaaatgctcatgatcgacagggttacccacattgaccaccacggtggggcgtatggcctcggactacttgttggagagaagatcttggatcgaaaccattggtactttccttgtcactttgtcaatgatcaagtcatggcagggtcactggtcagcgatggttgcagccagctcttaaaactctatatgatctggcttggcctccacctgaaaatggaggaatttgattttctcccagttagcggccacaaaaacaaggtgcgatgcaggggacaaatttcaccgcataaaggcaagcttgtctacgtcatggaaatcaaaaagatgggttacgatcaagcatctggaagcccatacgccatcgcggacgttgatatcattgacgtcaacgaagagctgggtcaaagttttgacatcaacgaccttgcgagctacggaaaaggtgacctgagcaaaaaaatcgtggttgacttcaaaggaattgctttgcagctcaaaggccgcgctttttcacgcatgagttccagctcgtccttgaacgaaggatggcaatgtgttccaaaaccaagccagagaatggaacacgaacagccccctgctcactgccttgcaagcgaccccgaagccccttcaactgtgacctggcacccaatgtcaaagcttcctggcaaccctacgccgttcttctccccttcatcttaccctccgagggcaatttgcttcatccctttcccgggcaatccccttgacaacaactgcaaggctggagaaatgcccctgaactggtacaacatgtcagagttcatgtgtggcaaggtttctaactgcttgggcccagaattcgcacgctttgacaagtcgaacaccagccggagccctgcttttgacttggctctggtgacccgagttgttgaagtcacaaacatggaacacggcaagtttctaaacgttgattgcaatccaagcaaaggcacaatggtgggggagtttgactgtccccaagacgcgtggttctttgatggttcgtgcaacgacggccatatgccgtattccattatcatggaaatcggactgcaaacctcaggtgttctcacctcggtgttgaaggcaccgctgactatggacaaggatgacattctctttcgaaacctcgatgcaagtgctgaaatggtgcgtccagacgtggatgttcgcggcaaaacgattcgaaacgtgaccaagtgtaccggctatgcaatgttgggaaagatggggattcaccggttcacgtttgagttgagcgttgacggcgtggtattttataaaggatccacttcctttggatggttcactcccgaggtgtttgctcagcaagctggactcgacaacgggaaaaagacggagccctggtgcaagactaacaacacctcggttcgaagagttgaaatcgcatccgccaaaggaaaagagcagctgactgagaagcttcccgacgcaactaatgctcaagttcttcggcgttcagagcagtgtgaatacctcgattacctcaatattgcccctgactctgggctgcatgggaagggctacgcccacggacacaaagacgttaacccgcaagactggttcttctcttgccacttttggttcgatcctgtaatgccaggatctttaggaattgaatcaatgttccagcttatcgaggcctttgcggtggaccaaaacattcctggagagtacaacgtatccaatccgacctttgcccatgcaccaggcaaaacggcgtggaaataccgaggccagctcacaccaaagaaccgtgcgatggactgcgaggtgcatatcgtttcaattaccgcctcccccgagaacgggggctacgttgacatcgtggccgatggagcgctttgggtagatggacttcgcgtgtacgaagccaaagagcttcgagttcgtgtcgtttcggcaaaacctcaagcaattccggatgtacaacaacagccacctagcgcaaaggcggacccggggaaaacaggagttgcactttcgcccactcagctacgcgacgtcctgcttgaagtggacaatccattgtatcttggtgtagagaactccaatttggtgcagtttgagtcgaaacctgcaacttcttcacgtatcgtttcgatcaaaccgtgctcgattagtgaccttggcgataagtcttttatggaaacgtacaacgtgtcagcacctctgtatactggagcaatggccaagggcattgcatccgccgacttggtcattgctgctgggaaacgcaagatacttggatcgtttggtgcgggagggctgcctatttccatagtccgtgaagcactggagaaaattcaacaacacctgccccacggcccctacgctgttaacctcattcactcgcctttcgacagcaacttggaaaagggcaacgttgacctctttctcgagatgggcgtgacagtggtagaatgcagcgcgttcatggaactcacggcccaggttgtccggtaccgcgcgtctggtctaagcaaaagtgcggacggttcgattcgcattgctcaccgtattattggcaaggtttccagaaccgagctggcagaaatgtttattcgtccagcaccacagcacctcctccaaaaactcgtagcctccggcgagctgacagctgagcaagccgagcttgcaacacaggttccggtggcggatgacattgcggtcgaagccgactcgggggggcataccgacaacaggcctattcacgtcattcttcctctaatcatcaacctacgcaaccgtttgcataaagagcttgactacccttcgcatctccgggtacgtgtgggtgctggtggtggtattggatgtcctcaagccgctcttgcagcatttcaaatgggggcagcgtttttaatcactggaacggtgaaccagcttgctcgtgaaagtggcacttgtgacaacgtccggttacagctctcaaaggccacgtatagcgacgtgtgtatggctcctgctgccgatatgtttgaccaaggcgtggagctgcaagtattgaagaaaggcacgctgttcccaagtcgtgctaagaagctgtacgagctgttctgcaagtatgactcgtttgaggcaatgccggctgaagaattgcaacgggttgaaaagcggatttttcaaaagtcgcttgctgaagtttggcaggagaccagtgacttttacattcatcgtatcaagaaccctgagaaaatcaatcgtgctgcaagcgatggcaaactgaaaatgtcgctttgctttcgctggtaccttgggctttcctcattttgggccaactctggggcacaagatcgcgtcatggactatcaaatttggtgtggccctgctattggcgctttcaatgattttaccaagggcacgtaccttgacgtgactgttgcaaagagttacccttgtgtggcacagatcaatttgcaaattttgcaaggagctgcgtatctgaaacgccttggtgtcattcgttttgaccgcatgctgctgcaggccgtcgatatcgacgatcctgtatttacttacgtgccgacccagccactt

SEQ ID NO: 62 - protein, 1470 aa, Thraustochytrium sp.
MGPRVASGKVPAWEMSKSELCDDRTVVFDYEELLEFAEGDISKVFGPEFKVVDGFRRRVRLPAREYLLVTRVTLMDAEVGNFRVGARMVTEYDVPVNGELSEGGDVPWAVLVEAGQCDLLLISYMGIDFQCKGERVYRLLNTTLTFFGVAKEGETLVYDIRVTGFAKRPDGDISMFFFEYDCYCNGKLLIEMRDGSAGFFTDEELAAGKGVVVTRAQQNMRDKIVRQSIEPFALAACTHKTTLNESDMQSLVERNWANVFGTSNKMAELNYKICARKMLMIDRVTHIDHHGGAYGLGLLVGEKILDRNHWYFPCHFVNDQVMAGSLVSDGCSQLLKLYMIWLGLHLKMEEFDFLPVSGHKNKVRCRGQISPHKGKLVYVMEIKKMGYDQASGSPYAIADVDIIDVNEELGQSFDINDLASYGKGDLSKKIVVDFKGIALQLKGRAFSRMSSSSSLNEGWQCVPKPSQRMEHEQPPAHCLASDPEAPSTVTWHPMSKLPGNPTPFFSPSSYPPRAICFIPFPGNPLDNNCKAGEMPLNWYNMSEFMCGKVSNCLGPEFARFDKSNTSRSPAFDLALVTRVVEVTNMEHGKFLNVDCNPSKGTMVGEFDCPQDAWFFDGSCNDGHMPYSIIMEIGLQTSGVLTSVLKAPLTMDKDDILFRNLDASAEMVRPDVDVRGKTIRNVTKCTGYAMLGKMGIHRFTFELSVDGVVFYKGSTSFGWFTPEVFAQQAGLDNGKKTEPWCKTNNTSVRRVEIASAKGKEQLTEKLPDATNAQVLRRSEQCEYLDYLNIAPDSGLHGKGYAHGHKDVNPQDWFFSCHFWFDPVMPGSLGIESMFQLIEAFAVDQNIPGEYNVSNPTFAHAPGKTAWKYRGQLTPKNRAMDCEVHIVSITASPENGGYVDIVADGALWVDGLRVYEAKELRVRVVSAKPQAIPDVQQQPPSAKADPGKTGVALSPTQLRDVLLEVDNPLYLGVENSNLVQFESKPATSSRIVSIKPCSISDLGDKSFMETYNVSAPLYTGAMAKGIASADLVIAAGKRKILGSFGAGGLPISIVREALEKIQQHLPHGPYAVNLIHSPFDSNLEKGNVDLFLEMGVTVVECSAFMELTAQVVRYRASGLSKSADGSIRIAHRIIGKVSRTELAEMFIRPAPQHLLQKLVASGELTAEQAELATQVPVADDIAVEADSGGHTDNRPIHVILPLIINLRNRLHKELDYPSHLRVRVGAGGGIGCPQAALAAFQMGAAFLITGTVNQLARESGTCDNVRLQLSKATYSDVCMAPAADMFDQGVELQVLKKGTLFPSRAKKLYELFCKYDSFEAMPAEELQRVEKRIFQKSLAEVWQETSDFYIHRIKNPEKINRAASDGKLKMSLCFRWYLGLSSFWANSGAQDRVMDYQIWCGPAIGAFNDFTKGTYLDVTVAKSYPCVAQINLQILQGAAYLKRLGVIRFDRMLLQAVDIDDPVFTYVPTQPL

SEQ ID NO: 63 - DNA, 1500 bp, Thraustochytrium sp.
  CDS (1)..(1500)
atgggcccgcgagtggcgtcaggcaaggtgccggcttgggagatgagcaagtccgagctgtgtgatgaccgcacggtagtctttgactatgaggagctgctggagttcgctgagggcgatatcagtaaggtttttgggccggagttcaaagtggtggacgggtttaggcgcagggtgaggttgcccgctcgagagtacctgctggtgacccgggttacgctgatggatgccgaggtgggcaactttcgagtgggagcacgtatggtgacagagtatgacgtacctgtgaacggagagctctcggaagggggagatgtgccgtgggctgtgttggtggaagccgggcagtgcgacttgctgctaatttcttacatgggcatcgatttccagtgcaaaggagagcgggtctaccggctgctgaacaccaccttgacgttttttggcgtcgcgaaagaaggggaaacgcttgtgtacgatattcgcgtcacgggtttcgccaagaggccggacggagatatctccatgttctttttcgaatatgattgctactgcaatggcaagcttctcatcgaaatgcgagatggctctgcaggcttcttcacggacgaagagctcgctgccggcaaaggagtggtcgtcactcgtgcacagcaaaacatgcgggacaaaattgtacggcagtccattgagccttttgcactggcggcttgcacgcacaaaacgactctgaacgagagtgacatgcagtcccttgtggagcgaaactgggcaaacgtttttggcaccagtaacaagatggcggagctcaactataaaatttgcgccaggaaaatgctcatgatcgacagggttacccacattgaccaccacggtggggcgtatggcctcggactacttgttggagagaagatcttggatcgaaaccattggtactttccttgtcactttgtcaatgatcaagtcatggcagggtcactggtcagcgatggttgcagccagctcttaaaactctatatgatctggcttggcctccacctgaaaatggaggaatttgattttctcccagttagcggccacaaaaacaaggtgcgatgcaggggacaaatttcaccgcataaaggcaagcttgtctacgtcatggaaatcaaaaagatgggttacgatcaagcatctggaagcccatacgccatcgcggacgttgatatcattgacgtcaacgaagagctgggtcaaagttttgacatcaacgaccttgcgagctacggaaaaggtgacctgagcaaaaaaatcgtggttgacttcaaaggaattgctttgcagctcaaaggccgcgctttttcacgcatgagttccagctcgtccttgaacgaaggatggcaatgtgttccaaaaccaagccagagaatggaacacgaacagccccctgctcactgccttgcaagcgaccccgaagccccttcaactgtgacctggcacccaatgtcaaagcttcctggcaac

SEQ ID NO: 64 - protein, 500 aa, Thraustochytrium sp.
MGPRVASGKVPAWEMSKSELCDDRTVVFDYEELLEFAEGDISKVFGPEFKVVDGFRRRVRLPAREYLLVTRVTLMDAEVGNFRVGARMVTEYDVPVNGELSEGGDVPWAVLVEAGQCDLLLISYMGIDFQCKGERVYRLLNTTLTFFGVAKEGETLVYDIRVTGFAKRPDGDISMFFFEYDCYCNGKLLIEMRDGSAGFFTDEELAAGKGVVVTRAQQNMRDKIVRQSIEPFALAACTHKTTLNESDMQSLVERNWANVFGTSNKMAELNYKICARKMLMIDRVTHIDHHGGAYGLGLLVGEKILDRNHWYFPCHFVNDQVMAGSLVSDGCSQLLKLYMIWLGLHLKMEEFDFLPVSGHKNKVRCRGQISPHKGKLVYVMEIKKMGYDQASGSPYAIADVDIIDVNEELGQSFDINDLASYGKGDLSKKIVVDFKGIALQLKGRAFSRMSSSSSLNEGWQCVPKPSQRMEHEQPPAHCLASDPEAPSTVTWHPMSKLPGN

SEQ ID NO: 65 - DNA, 1500 bp, Thraustochytrium sp.
  CDS (1)..(1500)
cctacgccgttcttctccccttcatcttaccctccgagggcaatttgcttcatccctttcccgggcaatccccttgacaacaactgcaaggctggagaaatgcccctgaactggtacaacatgtcagagttcatgtgtggcaaggtttctaactgcttgggcccagaattcgcacgctttgacaagtcgaacaccagccggagccctgcttttgacttggctctggtgacccgagttgttgaagtcacaaacatggaacacggcaagtttctaaacgttgattgcaatccaagcaaaggcacaatggtgggggagtttgactgtccccaagacgcgtggttctttgatggttcgtgcaacgacggccatatgccgtattccattatcatggaaatcggactgcaaacctcaggtgttctcacctcggtgttgaaggcaccgctgactatggacaaggatgacattctctttcgaaacctcgatgcaagtgctgaaatggtgcgtccagacgtggatgttcgcggcaaaacgattcgaaacgtgaccaagtgtaccggctatgcaatgttgggaaagatggggattcaccggttcacgtttgagttgagcgttgacggcgtggtattttataaaggatccacttcctttggatggttcactcccgaggtgtttgctcagcaagctggactcgacaacgggaaaaagacggagccctggtgcaagactaacaacacctcggttcgaagagttgaaatcgcatccgccaaaggaaaagagcagctgactgagaagcttcccgacgcaactaatgctcaagttcttcggcgttcagagcagtgtgaatacctcgattacctcaatattgcccctgactctgggctgcatgggaagggctacgcccacggacacaaagacgttaacccgcaagactggttcttctcttgccacttttggttcgatcctgtaatgccaggatctttaggaattgaatcaatgttccagcttatcgaggcctttgcggtggaccaaaacattcctggagagtacaacgtatccaatccgacctttgcccatgcaccaggcaaaacggcgtggaaataccgaggccagctcacaccaaagaaccgtgcgatggactgcgaggtgcatatcgtttcaattaccgcctcccccgagaacgggggctacgttgacatcgtggccgatggagcgctttgggtagatggacttcgcgtgtacgaagccaaagagcttcgagttcgtgtcgtttcggcaaaacctcaagcaattccggatgtacaacaacagccacctagcgcaaaggcggacccggggaaaacaggagttgcactttcgcccactcagctacgcgacgtcctgcttgaagtggacaatccattgtatcttggtgtagagaactccaatttggtgcagtttgagtcgaaacctgcaacttcttcacgtatcgtttcgatcaaaccgtgctcgattagtgacctt

SEQ ID NO: 66 - protein, 500 aa, Thraustochytrium sp.
PTPFFSPSSYPPRAICFIPFPGNPLDNNCKAGEMPLNWYNMSEFMCGKVSNCLGPEFARFDKSNTSRSPAFDLALVTRVVEVTNMEHGKFLNVDCNPSKGTMVGEFDCPQDAWFFDGSCNDGHMPYSIIMEIGLQTSGVLTSVLKAPLTMDKDDILFRNLDASAEMVRPDVDVRGKTIRNVTKCTGYAMLGKMGIHRFTFELSVDGVVFYKGSTSFGWFTPEVFAQQAGLDNGKKTEPWCKTNNTSVRRVEIASAKGKEQLTEKLPDATNAQVLRRSEQCEYLDYLNIAPDSGLHGKGYAHGHKDVNPQDWFFSCHFWFDPVMPGSLGIESMFQLIEAFAVDQNIPGEYNVSNPTFAHAPGKTAWKYRGQLTPKNRAMDCEVHIVSITASPENGGYVDIVADGALWVDGLRVYEAKELRVRVVSAKPQAIPDVQQQPPSAKADPGKTGVALSPTQLRDVLLEVDNPLYLGVENSNLVQFESKPATSSRIVSIKPCSISDL

SEQ ID NO: 67 - DNA, 1410 bp, Thraustochytrium sp.
  CDS (1)..(1410)
ggcgataagtcttttatggaaacgtacaacgtgtcagcacctctgtatactggagcaatggccaagggcattgcatccgccgacttggtcattgctgctgggaaacgcaagatacttggatcgtttggtgcgggagggctgcctatttccatagtccgtgaagcactggagaaaattcaacaacacctgccccacggcccctacgctgttaacctcattcactcgcctttcgacagcaacttggaaaagggcaacgttgacctctttctcgagatgggcgtgacagtggtagaatgcagcgcgttcatggaactcacggcccaggttgtccggtaccgcgcgtctggtctaagcaaaagtgcggacggttcgattcgcattgctcaccgtattattggcaaggtttccagaaccgagctggcagaaatgtttattcgtccagcaccacagcacctcctccaaaaactcgtagcctccggcgagctgacagctgagcaagccgagcttgcaacacaggttccggtggcggatgacattgcggtcgaagccgactcgggggggcataccgacaacaggcctattcacgtcattcttcctctaatcatcaacctacgcaaccgtttgcataaagagcttgactacccttcgcatctccgggtacgtgtgggtgctggtggtggtattggatgtcctcaagccgctcttgcagcatttcaaatgggggcagcgtttttaatcactggaacggtgaaccagcttgctcgtgaaagtggcacttgtgacaacgtccggttacagctctcaaaggccacgtatagcgacgtgtgtatggctcctgctgccgatatgtttgaccaaggcgtggagctgcaagtattgaagaaaggcacgctgttcccaagtcgtgctaagaagctgtacgagctgttctgcaagtatgactcgtttgaggcaatgccggctgaagaattgcaacgggttgaaaagcggatttttcaaaagtcgcttgctgaagtttggcaggagaccagtgacttttacattcatcgtatcaagaaccctgagaaaatcaatcgtgctgcaagcgatggcaaactgaaaatgtcgctttgctttcgctggtaccttgggctttcctcattttgggccaactctggggcacaagatcgcgtcatggactatcaaatttggtgtggccctgctattggcgctttcaatgattttaccaagggcacgtaccttgacgtgactgttgcaaagagttacccttgtgtggcacagatcaatttgcaaattttgcaaggagctgcgtatctgaaacgccttggtgtcattcgttttgaccgcatgctgctgcaggccgtcgatatcgacgatcctgtatttacttacgtgccgacccagccactt

SEQ ID NO: 68 - protein, 470 aa, Thraustochytrium sp.
GDKSFMETYNVSAPLYTGAMAKGIASADLVIAAGKRKILGSFGAGGLPISIVREALEKIQQHLPHGPYAVNLIHSPFDSNLEKGNVDLFLEMGVTVVECSAFMELTAQVVRYRASGLSKSADGSIRIAHRIIGKVSRTELAEMFIRPAPQHLLQKLVASGELTAEQAELATQVPVADDIAVEADSGGHTDNRPIHVILPLIINLRNRLHKELDYPSHLRVRVGAGGGIGCPQAALAAFQMGAAFLITGTVNQLARESGTCDNVRLQLSKATYSDVCMAPAADMFDQGVELQVLKKGTLFPSRAKKLYELFCKYDSFEAMPAEELQRVEKRIFQKSLAEVWQETSDFYIHRIKNPEKINRAASDGKLKMSLCFRWYLGLSSFWANSGAQDRVMDYQIWCGPAIGAFNDFTKGTYLDVTVAKSYPCVAQINLQILQGAAYLKRLGVIRFDRMLLQAVDIDDPVFTYVPTQPL

SEQ ID NO: 69 - DNA, 39669 bp, Sh. japonica
gatctggcgataacttactccccattccactgtatcagctgcctgcaacctttaacggcgatcataaacgcgtcattcgctggcagacagagtggcaagcctgtgatgaattacaaatggcagcggccacaaaggctgaatttgcagcattagaagaaattaccagtcatcaaagtgatttatttagacggggctgggatatcaggggcggagttgagtatttaactaaaatcccaacttattattatttataccgtgtcggtggcgaaaaccttgccagtgaaaaaaaccgagcttgtccacgttgcggctcaaaagcgtggcgtttagatgagccattattagacatgttccactttaggtgcgagccatgtcgaattgtatcgaatatctcatgggatcatcagtaaaattatcttctcgtcaatagatactaatacaacgagttagctgataacgcattatcggttcattcaataaaaaagccagaccgcatctatagcctgatctatagcctggcttttttattttatgtccgaataagcaattatttcttgcctttaatcaaatcattccacatcattttcattcgctgccaaatacctggatgagcaacatattcctctacaatcggctctaccggcggcgttactcgtggtgttagcgcatcaataaattccgcaagactatcggctaatttatctttgggcctatcacctggaatttcaatccacacactgccatcttcattatcgacagtaatcatctgttcgccatcacctaaaacgccaacaaaccaagttggtgcttgtttaagctttttcttcatcattaagtggccaattacattttgttgcaaagattcaaaatcttgctggttccaaacctgcagtaactccccttcgccccatttagaatcgaaaaaaagtggcgcagaaaaaaactcaccataaaaggcattaatgtcttgatgaagcttgatgtctaatgcatgttctacattactgaaatctgaattactttttcgttttaccgctttccaaaaaaccgcaccgtcagattcaagatcatacttgccttcaatacaagcggatccttgcccaagtgggaaataacggggtaactcgtctaatacatcctgataagcttgtatataacggctagaaaaatgttccaatgaagttgaacaagacacttaagatgctccagttttgggttataataaaagtctattttgacacggaaacagactagatgacacacaatcacgacccctatagtgatgcagatgcacttaaaggactcactttaggtcaatcgacgcaatatcaagcagaatatgatgcttcactgctgcaaggggttcctcgtaaacttaatcgcgacgctattgaattaactgatactctgccgtttcaaggggcagatatttggactggctacgagttatcttggttgaacgccaaaggtaaacctatggtcgcaatgattgaagtttaccttgctatcgaaagtgataatttaatcgaatcaaaatcgttcaagttgtatttaaacagctttaaccaaacacgttttgacagtgtagaccacgttcagcaaaccttaaccactgacttaagccaatgcgctaatggtaaggtaacagtgaaagtgattgagcctaagcatttcaatactcaacgtattgttgaactacctggcaattgtatcgatgagctagatattgaagtcaatgattatgaatttaaccctgagtacttgcaagacagcactgaagagaaaaatgttgtcgaaacactcacatcaaacttattaaaatctaactgtttaatcacttcacagcctgattggggaagtgtgatgatccgttatcaaggcccaaagattaatcatgaaaagctattgcgctatttaatctcattccgccaacataatgaatttcatgagcaatgtgtagagcgtatttttaccgacctaaaacgatactgtcattgtactaagctcactgtttatgcacgttatactcgccgcggtggattggatatcaacccattcagaagcgaccttgagcaacctccagagacgcaccgtttagcaagacaataaatagcttattcatcaatcagcttaatgaataaagcctaatccctaggctttattcatttattttctgtcgtaataccgagcccttcatgcctacagacaatgttacttgtttaacaccaacaactgacgatattcagtcccataagcatttcaaaatatttaaaccctttggttttttaagtcagtttgtgcctgaaactcgaaagaaaaaacacttattgggcgagttatgtcagtttccagataaaaccatggcaattggtcgattagaccatgattctgaaggcttattactgctaacaactgacggcatgatgagccataaagtgagaagtaaaggcatcgaaaaagaatattatgttcaagtggatggcgatatcgatgacaaggcgatgtcacaactacaaaacggagttgaaattggcattaatagcacgaaatatctcactcagccctgtaaagcagtcaagctaaacgcagagccaatacttccctcacgcggtaaaaaaatccgcgatccaagacatggccccaccagctgggtttcaatcacattaactgaaggtaaaaaccgtcaaatcagaaaaatgaccgctgccgttggctttgccacattaaggcttgttagggtcagaattggtaatatacatattgatgatatgcgagctggcgacgttattgaactcaataacttagattcagtaataaaccctaaccttagctaacccataaaacggggctattcatttatcggcttaccttactagttattggttaaatacactttctccatcgcagactccaccagctcccgtaaccactttatcgcagggtcttgatgattacgtgttggccaaatactgtaaatcgaaatcacttggctttcaaaaggcaagtccatcaaaattaaattaaaaatagattgatagtttttcgcgtaggtataaggcgcaatacatatggcatcggatttactcacgccagataacatcgtcagtaaagaggatttttcaccatacatatctcgttcaggtaaatggtctgttgaaatcatctctgcaactcgctggttatgacgatgaagtcgataaaacagatgcttagcagcgaagtacgacacttcatctattccatgtttaaattgcgggtgctcagccctagcaacacaaacaagcttttcggtggcaatttgcttactggtaaagctcgcttcagttggcgcaacaatatctagcgctaaatcaatttgctgatttttaagggcttgatataaattaccctcatctaaaatcgcttctgtaaaaatgatttcaacgcctttatccgtcagtgacttttcgatatctgcttcaatcaaatcaataattgattcattagcgctgacatgaaatatccgttttgacaacgaagggtcaaaggctttaacgctattaatgcattgttcgatttcgatgagtggcaaacttaactgtcggtgcaagtgctgacctatcgcagtgagagctatccctcttccttgcctaataaatagttcaacacccacaaccgctttaaaccgattgatagcattactgactgacgactgagttaatgcaaggtgctccgctgcaagcgtaatagattgataatcacatacacagcaaaaaactctaataaggttaagatccaacttaagtaattgttgttgcataagagcatcagactctaagttctcttgcttcatcacttctcccataacacatatcgccaaatacattcacacggtaaatgtattaaccatttttagccatagttatatttgggctttttattgttaacttatctttaacaataaaaagtacccgaggcctacatgagaaaaacacgagttgctttagtcatcagtttatcatttaccaatgcagtggctgctgcgcagcacgaacatgaccacatcagtcttgattaccagggtaagcctgcgacgcccattaccgcagagcacaacaaagccatagcacaaaagttaccgttcgaagataaatccgcttttgagcgctttagtcgacataaaattgcctcttttgatgaagccaccgccaagatactgcgtgcagaatttaactttatcagtgacacgcttcctgattcagtcaacccttcgttatatcgccaagctcaacttaatatggtaccagacgggctctataaagtgactgatggcatttaccaagtacgaggcactgacttatctaacttaacccttattcgaggtaaaacgggttggattgtatatgacgttttattaactaaagaagctgttcagcaatcattaacatttgcttttgctcacttgcctgagggcaaagatttacctgttgtggcaatgatttactctcacagccatgcagatcatttcggtggtgcccgtggcgttcaggaacgctaccctgatgtcaaagtgtatggttcatataatattacccaagagatagtggatgaaaatgtactcgcgggtaatgtcatgagccggcgagctgcttaccaatacggcgttacactcgataaacacaatcacggaattgtcgatgcagcgttagcaaaaggtttatcaaaaggcgaaatcacttacgtcaaacctgattatgaacttcatcatcaaggcaaatgggaaaccttgaccattgatggtcttgaaatggtctttatggatgcatctggcactgaagctgccagtgaaatgatcacatatataccatctatgaaggcgctatggtcaggcgaattaacatatgatggtatgcacaatatttataccttacgaggcgctaaagttcgcgacgcattaaaatggtctaaagacattaacgagatgattaatgcatttggcgaaaatgttcaggtactatttgcttcacattctgcgccggtatggggaaataaagaaattaatcattaccttcgcatgcagcgagataattatggcctcgttcataatcaatctttacgtttagccaatgaaggtgtggtaatacaagatattggtgatgcaatcatggaaaccattccacaaaatgtccaagacgaatggtacaccaatggttatcacggtacatacagccataacgctaaagctgtgtacaacatgtatttaggctattttgatatgaatccagccaacttaaaccccttacctacaaaggctgaagcaattaagtttgtagaatatatgggcggcgccaacaatgtagtatcaaaagcgcaagcagacttcaatcaaggcgagtatcggtttgtcgccactgcattaaataaggtggtcatggccgaaccacaacacccccaagcccgagaattacttgccgatacctatgagcaacttggctaccaagccgaaggagctggttggcgaaatatttacttaacaggtgcgcaagagttacgtattggcattaaacctggcgcacctaaatccgcatccgctgatgttatcagcgaaatggacatgtccactttatttgactttctcgcggttaaagttgacagcattaacgccgccaagcttggcaatatcactttaaatgtggtgacacaaagcggcgataaaactgacacgctctttgtagagttaagtaacggaaacttgagtaatatcaaagtagacgaggctaaaaaagccgatgccacactgacaattaataagtctgatgtcgttgcaatattattaggtaaagcagatatgaaagcgttaatgcaatcaggagctgcgagtatgcaaggtgacaaattagcatttgccaaaattgcatcaacactggtgcaatttaatcctgattttgaaatcgtaccgctacagcatactcattagctcataacttaacgaaattcggctgcgaagtttttcactctgcttctttgcttatattcactagtttaccaagagtaatggcatgagagtttaaagcaaaaatgaccgactaagacaagtgagggaagattgttctgataagccgtttttgattagcagttaaacatccaaaaaaccttaacagttcgataaatcagttggtttttatgaacatttttatttgttcatgccagctgattttttttgcctttaattgaagtgttaatggcttttcgccaaaagcgaactcgcccacactcacagcaaatcgatatgaattattaagcttacctaaacaacattgccataaaggtgagacttcataaaaagactcaacatcattagtctgttcaagctcatcaacgtctgtaggcttcaataagctaagtgaaatatcatgctgaattggcaacaactgatcatctattgttaagttagctaagctcggtgcagataagtcaaatgcaaacgatttaagcgacaaggccagtcccagtccctttgctttaatataagattctttcagtgcccataaatcgaaaaatcgctcacgctgctgactttcaggtaacgccaataatgcagtttcttctggttttgaaaaatagtgatgtaaaattgaatggatattcgtgctttctcggcgacgttcaatatcgacccccaattgaatgggcattgaagcgtcctctttggagtgaatgacaccaataagcaaccagttaccactgtgacttaaattaaactgtaagcccgtttgtttatattgcacagccgatagcctaggtttgcccttctcaccatactcaaattgccaatcgtctggttcgatatttgcaaagttcgataatacgctgcgcaaatacccacgcaccattaacccttgctgttgagcagcctgttgaataaaacgatccactttatttatctcagcatcagataaccatgaacgcactgtagagacggttttctcatctaataaattggtatctaaaggacaaaaaaataattgaatagtgggtaaagggctcaaaccaaactcgcatttataatagcaataagacattgtcgcttgttctaggtcgctaattcaacacataaacaatcttgattgaaaatgtcgtctaaggtttaaacaaataaaggaaggtttagacaaataaaaaagggttaagccatccttaaccctttgcatatcatctgttatttcaataagtattagccaatcaatctaccagtgcttttaccgcctttttaggtaaaacatcataacggctaaactgcattgaaaactgaccttctccacctgtcatagatttaagctttgaagagtagctactgacattggcaagtggcacttcaacgctgacttcaacaagtccattggcatttgcctgcgttccacaaataatgcctctagatgcactaatgtcacctgtcacttcgccgacatgctcttgcccaactaaaatgctcatatcaactaatggttctaacattacaggttttgctaacgatactgcttctataaaagcttttttacccgccatcacaaaagcaatttctttagagtctacactgtggtgtttgccatccaataacgtgacttttatgtcttgtaatggatagccacctaactcaccggctagcatggcttctcgcacgcctttctctactgctggaatatattgacttggcactgagccaccaaccaccttcgaaataaactcaaagccttcaccacgctcaagtggctcaatggctaattcaacttcaccaaattggccagatccgcctgattgttttttatggcgataacggcattgtgctttctcggtgatggtttctcgataagccaccgccggcgtatcagtatccatgtcgaggtggaacatattttgcgctttttcaagcgcaatttttaaatgcaaatccccttgaccttgcaatacggtttgcccttcaacctcacttcgagtgatgtgtaaacttggatcttcagcgaccagtttattgagaacatcggagatcttttgttcatcaccacgacgcttggctgatacagccaaaccaaaaataggttgcggcacttccagttctggtaaatgaaattcatcttcatcatggctatcatgcagtacagaaccaacacttaatgcatccaattttgcaatagcgcaaatatcgccaggaaacgcttgggatacattaatttgtttatcgccttgaagcttcattaagtgagagactttgaaaggtttgcggccttggccaataagcagcttcatgccaacattcagcgtcccttggtacaacctaaatacgcccagtcttcctaaaaatgggtcaattgaaacgctaaacacatgggctaaaacatgatctgttgccttttgtgtcactgttactggtgtcgactgttcaccaaatcctttcataaattgtggtgcattggcttcaagtggacttggcatgagtttgatcaacatttctaacaatgaactaatcccaatatcttgttctgcacttgtaaagcagactggcactaagtgccccattctgagtgctttttctagcggagcatgaagctgctgaggcgttaacgactcaccttgctctaaatacaaggtcattaacgcttcatcttcttcaagtaccgtatcaactagctcatctctagcactagcaggttgactaaataatgtctctgcactttcatcacaatgtaaataacaatcaacaacggcttttccatcggcactgggcaagttaaccggtaaacatcggtgtccaaattgatgctgaatgtcgatcatcacatctgacactcgcgtgagattactgtcgaggtggttaatggcaataatcaccgctttaccttgcgctcttgcagcttcaaaagcacgtttagtcacagactctataccaacggcggcattaataaccaacagtactgactcaacggcaggcaaaggtaataaggctcgcccgaaaaagtcaggtaaacctggcgtgtcgataaaattgatatgatgctgttgatactgaaggtgtaaaaatgaaggctctaaactgtgacggtgggatttttcttgggcagtgaaatcagcatgatttgtgcccttgtcgaccctgccttttaacgatattgccttagctctatacagcaatgcttcaagcaaggatgatttgcctgctccaacatgtccgagcacagccaaattacgggtttgctcagtagtaaactcagccataatggcctcctgttttcacattattaaactttccatattcttgtctaactttgtttacgtttggctatttattgcgcataaaaatagcatacggggctaacaactcagatgaattgacctagatcagtgtttacatcggcaacgttttttataacaaaatcacccattcggcttacaagtgttagctaattctggtcgtatcagtgattaattagtttcgggtgattgtatcgacccgaaacctcaggtactctgcatgctcgattgtgctaaaacgctaattttgaagatgaacaaacgttaatcttcacgtttttataccgagtcccaacagattgtacggagtattcatcgaactatggcagtccttaaatgaccgcaaatagaaaagctcacgctgtaactcaaacagccgctaagaaagccacatcagaaaccgatgttgcgatggcccctgttcgccatagcaatgcaacaacgactcctgaaatgcgtcaatttattcagacttctgatttcagtgttagtcaattggctaagattcttaatatctcggaagccactgtcagaaagtggcgcaagcgcgactcaatcagtgatacgcccaatactccacatcatttgaaaaccacgctttcaccaatggaagaatacgtggttgtgggacttcgttatcaattaaaaatgtcactggatagattgcttcacgtcacacaacaatttatcaaccctaacgtctctcgctctggtttagcccgatgtttaaagcgctacggcatatcaaaactagatgaatttgaaagccctcatgtgcctgagtgttattttaatcagctgcctattgttcagggtacagatgtagcgacttatacactgaaccctgaaacgctcgctaaaacccttgcattacctgaagcgacaccagataacgttgtacaggttgtatcgttaacgattccacctcaactcactcaagcggacagttattccattttgctcggtgtcgactttgcaaccgactgggtgtatctcgacatatatcaagacaatcacacacaagcgacaaatcgttatatcgcttatgtgttaaagcacggcccgtttcatttacgtaagttattagtcaaaaattaccacacctttttagcccgctttcctggcgcaacagttttacaatccacggaagcggcaaaccaaaaaaataaatcagctaaggatcagctgaacactggagactcaaaatgagccaagcccctacaaatcctgagacaagctctcaagataataacgagtcgcaagatacaagactgaataaacgtcttaaagacatgcccattgccattgtcggcatggccagtatctttgccaactctcgttacctgaataagttttgggacttaatcagcgaaaaaattgatgctattaccgaagtacctgatacccactggcgcgctgaagattactttgatgctgacaagagcaccccagataagagctactgtaaacgcggtggttttatccctgaagtggactttaacccaatggaatttggcctgccgccaaatatcctagaactgaccgatacttcgcaattattgtcattagtgattgccaaagaagtgctagcagatgctggtgtcacttctgaatatgacactgataaaatcggtattactttaggtgtgggcggtggccaaaaaattaatgccagcctaacagcacgtctgcaataccctgtgcttaaaaaagtatttaaaagcagcggcctaagcgatgccgacagcgacatgcttatcaaaaaattccaagaccaatacattcactgggaagaaaactcgttcccaggatcgcttggtaatgttattgctggtcgtattgctaaccgctttgacttaggcggcatgaactgtgtggttgatgcggcatgtgcaggttcacttgcggcaatgcgtatggcgttaaccgaactggttgaaggccgcagcgaaatgatgatcactggtggcgtatgtaccgataactcgccatcgatgtacatgagtttttcaaaaaccccagcgtttaccaccaatgaaacgattcagccatttgatatcgactcaaaaggcatgatgattggtgaaggcattggcatggtggcattaaaacgtcttgaagatgctgagcgtgacggtgaccgtatttactcagtcattaaaggggtcggcgcttcatctgatggtaagttcaaatcaatttatgcacctcgacctgaaggccaagctaaagcgctgaagcgtgcttatgatgacgccggctttgcacctgaaaccgttggcttaattgaagctcacggaacaggcactgcagcgggtgatgtggcagaatttaatggtcttaaatctgtatttggtgagaatgactcaacaaagcaacacattgctttaggttcagttaagtcacaagtgggccatactaaatcaactgcgggaaccgcgggtgtgattaaagcggcgttagcactgcatcataaagtgctgccgccaaccatcaacgtctctaagcctaaccctaagcttaatgttgaggattcaccgtttttcattaacactgaaactcgcccttggatgcctcgccctgatggcacaccacgccgagctggtataagttcgttcggttttggtggcacaaacttccacttagtactagaagaatacagcccagagcacagccgtgatgagaaatatcgtcagcgccaagtagcacaaagcttattgattagcgctgacaataaagctgagctcattgcagaaatcaacaagcttaacgctgacatcagcgcgcttaaaggcacagataacagcagcatcgaacaagctgaacttgcccgcattgctaaactatatgctgttcgcactttagatacttcagcagcccgtttgggtcttgtggtctcaagccttaatgaattaaccactcaacttggtttagcgttaaagcagctaagtaacgacgctgaagcatggcaattaccatcaggtacgagctatcgctcatctgcgctcatcacgattaatgccaaccaaaagacgactaaaggtaaaaaagcagctaacacaccgaaagtagcagcattatttgcaggtcaaggttctcagtacgtcaacatggggattgatgttgcttgtcacttccctgaaatgcgccagcaattaatcaaagccgacaaggtatttgcaagctttgataaaacgccattatcgcaagtgatgttcccaattccagcctttgaaaaagcagataaagatgcgcaagcagctttactcaccagcactgataacgcgcaaagcgccattggtgtaatgagcatgagccaataccaactgtttactcaatcaggttttagcgcagatatgtttgcaggtcacagctttggtgagctttcagctctttgcgctgctggcgttatttctaatgacgactactaccaattatcctatgctcgcggcgcttcaatggccgcatcagcagttgataaagatggcaatgaattagataaaggcacgatgtacgccattatcttgccagctaatgaaaatgatgcagcaaatagcgataacatcgctaaattagaaagctgcattagcgagtttgaaggcgttaaggtggctaactacaactcagccactcagctagttattgcaggcccaacacaaagctgcgccgatgcagctaaagccattgccgctttaggctttaaagctatcgcgctacctgtttctggcgccttccacacaccacttgtggggcatgcgcaaaagccatttgctaaagccattgataaagctaagttcacggcgagcaaagtcgacctgttctcaaatgccactggtgacaaacacccaagtgacgctaaatcaattaaagccgctttcaagcaacatatgctgcaatcagttcgttttactgatcagctgaacaatatgtacgatgcgggagcgcgcgtatttgtcgagttcggccctaagaacattctgcaaaaactggttgaagcgaccctaggtaataaagctgaagcggtatccgttatcagtatcaatccaaaccctaagggcaacagtgatgtgcaacttcgtgttgcagctatgcaacttagcgttttaggtgcgccactctcaagcattgacccttatcaagctgaaatcgcagctcctgcggtaccaaaaggcatgaacgttaaactcaatgcaaccaaccacatcagtgcacctactcgtgccaagatggaaaaatcattagcaacaggccaagtaacctctcaagttgtcgaaacaattgttgagaaagttatcgaaaaacctgttgaaaaagtagtagagaagatcgtggaaaaagaagtcattaaaactgaatatgttgaagttgccacatctggcgcaacaacagtgtctaacgttgcgcctcaagcaatagcacctcatgcatcagctcaggctgctcctgcttctggcagtttagaagcgttctttaatgcacaacagcaagccgctgatctgcatcagcaattcttagcgattccgcagcaatatggtgacacctttactcacttgatggcagagcaaagtaaaatggttgctgcaggccaagccattcctgaaagcttgcaacgctcgattgagttattccatcagcatcaagcgcaaacgctacaaagtcacaccctgtttttagaacaacaagctcaggcaagccaaaatgcattaaacatgctaacgggtcaaacacctgttactgctcctgttgttaacgcaccaattgttaattcaccagtagttgaagcggtgaaagtagcacctcctgtacaaactcctgtcgtaaacacgccagtagtaccagcagtaaaggccacacctgtagctcaacctgctgcgatggccgctccaaccccacctgttgaaccaattaaagcacctgctcctgtagccgctcctgtagtaagtgcacctgtagttcctacccctgctggcttaagcgcacaaacagccctgagctcacaaaaagttctggatactatgttagaagtggttgcagaaaaaaccggttacccaactgaaatgcttgaacttagcatggacatggaagcagacttaggcatcgattcaattaaacgtgttgaaatattaggtactgttcaagacgaactaccaacactgccagaactcagtcctgaagatttagctgagtgtcgtacattgggcgaaatcgttgactatatgggtagtaaactaccggccgcaggcgctatgaacagcgacactgcaaatgcaactcacacagccgtttccgcccctgccgcttcaggtcttagcgcagaaacagtactcaacactatgcttgaagtggttgcagaaaaaacaggttatccaactgaaatgcttgaactaagcatggacatggaagccgatttaggcatcgattcaattaaacgtgttgaaatattaggtactgttcaagacgaactgccaacaccgccagagctaagccctgaagatttagctgagtgtcgtacactgggtgaaatcgtatcttatatgggtagtaaactacccgccgcaggcgctatgaactctaaacttcctgcaagtgccgctgaagtagctcaaccccaaaccgcgccagttcaagctgcatctggccttagcgctgaaacagttctgaataccatgctagaagtcgttgcagaaaaaaccggttacccaactgaaatgcttgaactcagcatggacatggaagccgatttaggcatcgattcaattaaacgtgttgaaatattaggtactgttcaagacgaactgccaacactgccagagctaagccctgaagatttagctgagtgtcgtactcttggtgaaatcgttgactacatgaactctaagctacccgctgctggttctgccccagttgcatcaccagttcagtctgcgactccggtatctggtcttagcgctgaaacagttttgaataccatgctagaagtcgttgctgaaaagactggttatccgactgatatgcttgaattaagcatggatatggaagccgatttaggcatcgattcaatcaagcgtgttgagatattaggtactgttcaagacgagctgccaacactacctgaactcagccctgaagatttagctgagtgtcgtactcttggcgagatcgttgactatatgggtagtaaactacccgccgcaggcgctatgaacactaagcttcctgctgaaggcgctaatacacaggccgccgcaggcgctgctcaagtagcagctactcaaacatcaggtttaagtgcggaacaagttcaaagcactatgatgacagtggttgctgagaagaccggttacccgactgaaatgcttgaattaagcatggatatggaagcggatttaggcatcgattcaatcaagcgagttgagatcttaggtacagttcaagatgaacttccgacgctaccagaacttaaccctgaagatttagctgagtgtcgtacacttggtgagatcgtttcgtacatgggtggtaaactacccgccgcaggcgctatgaacactaagctacctgctgaaggcgctaatacacaggccgcagcaggcgcttctcaagtagctgcctcaaccgcagaaacagccctgagcgctgagcaagttcaaagcaccatgatgactgtggttgctgaaaaaaccggttacccaactgaaatgcttgaattgagcatggatatggaagcggatttaggcatcgattcaatcaagcgtgttgaaattttagggacggttcaagacgagcttccgggcttacctgaattaaatcctgaagatttagcagagtgtcgcaccctaggcgaaatcgtatcttatatgggcgctaaactgccagccgcaggcgctatgaacaaaaagcaagcgagcgttgaaactcaatctgcacccgcagcagagttagcaactgacttacctcctcatcaggaagttgcgctaaaaaagctaccagcggcggataagttagttgacggtttttcaaaagacgcctgtatcgttatcaatgatgacggccataacgcaggtgttttagctgaaaaattagtagcaacaggcctaaccgtcgccgttattcgtagccctgagtcagtgacatctgcgcaatcaccgcttagcagtgatattgccagcttcactttatctgcggtcaatgacgacgcgattagcgatgtcattgctcaaattagcaagcagcataagatcgccggttttgttcacctacaacctcaactaacagcacaaggagctttgcctttaagtgatgctggttttgtagcagtagagcaagctttcttgatggctaaacacctacagaaaccatttgctgagctagcaaaaactgagcgtgtcagctttatgactgtcagccgcatcgatggtggctttggttacttaaacacggctgaacttgccaaagcagagctaaaccaagctgcattatcaggtttaactaaaacattaggtcatgagtggccaactgtgttctgtagagcattggatattaccccaagctttgaagctgtcgagttagcacaagccgttattgcagagctatttgatgttgatacagcaacagctgaagtgggtattagcgaccaaggtcgtcatactttatcagctacggcaactgctcaaacccgttaccaaaccacatctttaaacagtgaagatactgtattggtgactggcggtgctaaaggcgtcacatttgaatgtgcccttactcttgccaaacaaactcagtcgcactttattttagcgggtcgcagtgagcatttagccggtaatttaccgacttgggcaaagagtgtcatagcggctgcgcctaacgttagtgaagtaaacacaagtcagttaaaagcagcagcaatcggatttattcaatctcaaggtaacaagccaacacctaagcaaattgatgccttagtttggccgattaccagcagtttagaaattgatcgctcattagcagcatttaaagctgtcggtgcaagtgctgagtacatcagcatggatgtcagctcagatgcagccatcaagcaatctcttgcaggtgttaaaccgattacaggcatcattcatggtgcaggtgtactcgctgataaacatattcaagacaaaaccttagctgagttaggccgtgtatatggcactaaagtgtcgggctttgcaggtatcatcaatgcgattgatgcaagcaagttaaaactggttgctatgttctcatcagcagccggcttctatggcaatactggccaaagtgactactcaatgtctaatgagatcctcaacaagacagcacttcaacttgcagctaactacccgcaagctaaagtaatgagctttaactggggcccttgggatggcggaatggtcagttcagcattgaagaaaatgtttgttgagcgcggcgtatacgttattccactcgataaaggcgcaaacttgtttgctcacagcctattgtctgagtcgggcgtacagttattaattggttcaagcatgcagggctcaagctcagcagataaaacaggcgcagctgtaaaaaagcttaatgcggactcttcgcttaatgccgagggttcgctgattctttcttttactactcctgctaaccgtgttgtcaacaacgcggttactgttgaacgtgtactaaacccagtagcaatgcccttccttgaagatcattgcatcgcgggtaatccagtactaccgacagtgtgcgccatacaatggatgcgtgaaacagcgcaacaattgtgtggtctgcctgtgactgttcaagattataaattgctgaaaggcattattttcgagactaaagagccgcaagtattaacgctaacattgacgcaaactgaatcaggcttaaaagcactgatcgcgagtcgtatgcatcgcgatccaatggatagcttgctaagacctcagtatcaagcaaaccttgtgatcaatgaagccgtcattaacggtcaaactttaacaacacagccaactatcgttgcggatgcacaacagttagcaagtgcaggtaaagtgattagcactgacagcgaactttattcaaacggtagcttatttcatggaccacgcctgcaaggcatcaagcaagtcttgattgctgatgacacacaactggtttgcaacgtggaattaccacatattagttccgcagattgcgcaggctttgcgcctaatctgtccataggtggcagccaagcatttgctgaagatttgctactgcaagccatgttagtgtgggcacgaattaaccatgatgctgcaagcttaccatcgactattggtaagttaacgacttattcaccatttgcatcaggcgataaaggttacttggtgttatctgtgcttaagagtaccagccgttcgttaacagctgatattgcactttatcaccaagatggtcgcttgagttgcactatgagcagtgcaaaaacaacaattagcaaaagcttaaatgaggcatttcttgcccctgctaaagcaattgctgacttgcaggagtctgtgtgagcactcaactgactgcaaaaacggctgcaatcaatagtattcgtatagccttaaaactggtcgcgaatgatcaaacatcattcgcaccagcacaaaatgctgatgacatattttcagccataaaaccgtgttcattagcgcaggtcattggcgagtctgccattgaccttgaaattgatgtatcaagcttagatgcaggcatagataaccttgctacagcaagccaacaaacgcttagctttagtgattattttgcccaagcgattgcccatattgagcagcaacatactgtgttactgagccatccagcaataccgtatcgagtattgatgatgccagcgattgttgcagctaagcatcgctgtcatccccatgcctatttaacgggtttgggagaagctgatgatatgcaatgcgctatgcaaaacgctttagcacaagctaaacgtgagcacattactcctaccttggtcgatgtcactgagttaacttgttataaagacaagtttactcagcttgtcatgttgataagccgtattgctgcgcgtcgtttacctgacactacattgcctactgtcactagtgacaagcagaacaatagcaatcaagccaatgccaaatattggtttacccaaatgcaccaaaaccgtgttgctagctttaactttacagaaaatggcaagcaacacgctgccgtttttgttcaaggtactgaactggcccaggccagctcgatgcttgatgaaaacagactattcttccccttagcagccaatacatctgcttgcatgatccaatctttgcatgagctattagtggcgctcaataggcttaatcagcaacaaagcaatccgttagacagccagcggcttctaaacaagcctagccatgttatctctttaatgctcaattacttaaaggcatttgatcaaaccaaatccttgtctgcagttatcatagccaactctgtagtcactgcaatcgcagaaattgaggccatgttagccaaaatcagtacagcaagtgatgacacctctggatcgataaatgaacttgagtacaaaacgccttcgggtagttgtttaaccatcactcatcatgaagcgcttggtcgcagcggcgtgtgttttgtgtatccgggtgtgggtacggtttatccgcaaatgtttgcacaactgccacagtacttccccgctctgtttgctcaacttgaacgtgatggcgatgtaaaagccatgcttcaagctgattgtatttatgcagaaaatgccaaaacctcagacatgaatttaggcgagcttgctattgctggggttggcgcaagttatatattaactaaagtgcttaccgaacactttgccattaagcctgattttgcaatgggctattctatgggtgaagcatcaatgtgggccagccttaatgtctggaaaacgcctcacaatatgattgaagccactcaaactaatagtattttcacctctgatatttcaggccgactcgactgcgtccgtcaagcatggcaactcgaacagggtgaagatattgtttggaatagctttgttgtgcgtgctgcgccgactgaaatagaagccgtgcttgccgattaccctcgcgcatatttagcgattatacaaggtgatacctgtgtattagcgggttgtgagcaaagctgtaaagccttattgaaacaaatcggtaaacgtggcattgcagcaaatcgtgtcacagccatgcacacgcaacccgccatgcttattcgtgataatgttcaagcgttttatcagcaagctttgcacgaccaagatgtgcttgatgcacaagcaagtagcatcaaattcattagtgctgcgagtcaaatacctatttcattgaccagtcaggacatcgccaattccattgcagatacattttgtcagccactgaacttcactaaactggtgaataatgctcgtcatttaggtgcacgtttatttgttgaaattggcgcagataggcaaaccagtaccttgatagataaaattgcccgcactgcagctaataccgattcacatttaaacgcgccactgtcagccattgcaatcaatgccaaaggtgatgatcaaacagcgctgcttaaatgtatcgctcagcttatctcgcataaagtgcctttatctctacaatatctaactgagaatttatcccatttgttgaccgctagcattactcgcgaaaaccgtcagcaaagccaaaccgctcagttagctccacaattagaaggagaacaatcttgagttctcaatcaaacgttcccaaaattgccatcgtcggtttagcgactcagtaccccgatgctgatacgccagcaaagttctggcaaaatttattagataaaaaagactctcgcagcaccattagtcagcaaaagctcaatgcaaacccagctgactttcaaggtgttcaaggccagtctgaccgtttttattgtgacaaaggtggctacattcaagactttagttttgatgccaatggttaccgtattccagctgcgcagtttaatggtcttgacgacagttttttatgggcaacagacacggcgcgtaaagcactcaatgatgctggtgtggatatcactaacagtcaagataatgcgatattaaatcgcactggtattgtcatgggtaccttgtcgttcccaacggcaaaatctaacgaattgtttgtgccgatttatcacagcgccgttgaaaaagcgctacaagataagctgcaacaacccagtttcacattgcagccttttgatagtgagggatatagcaagcaaacaacgccagcctctttgtctaatggcgccattgcacataatgcatcaaaattagtggccgatgccctagggttaggcgcagcacaactcagccttgatgccgcttgcgcgagctcagtttactcattaaagctagcttgtgattacttgcatacaggcaaagctgacatgatgcttgctggtgcggtttcaggcgcagatcccttctttattaacatgggtttttctatcttccatgcttacccagaccatggcatttcagcgccttttgatagtaattcaaaagggttatttgcaggtgaaggtgctggcgttttagtgctcaaacgtcttgaagatgctgagcgtgatggcgaccatatttatgcactagttagcggcattggcttatccaacgatggtaaaggtcaatttgtactgagcccaaacagtgatggtcaagtcaaagcctttgagcgtgcctatgcagatgcagccatgcatgatgaacatttcggccctgataatattgaggtcatcgagtgtcatgccactggcacaccgctgggtgataaagttgaactgacctcgatggaacgtttttttaacgacaaactcaatggtagccatacgccattgattggctcagctaaatcaaacttaggtcatttgctgacggctgcgggtatgcctgggatcatgaaaatgatttttgccatgcgccaaggtatgttgccacccagtatcaatattagttcgccaattacatcaccaaatcagatgtttggccctgctacattacctaatgatgtattgccgtggcctgataaagcgggcaatcgtgctcgtcatgctggtgtctcagtattcggctttggtggttgtaatgcccacttattgattgagtcatatcacggacaaacgtcaacagctccagctgctaataccattaatgcacagttgcctatgcatattacaggcatggcatcacactttgggccgctgaataatattaaccgctttgccaatgcaataaaccagcaacaaacggcctttactccgctaccggcaaaacgctggaaaggcttagataaacatcctgagttattgcagcagcttggtttggcgcaaacaccgccaacaggggcttatattgatcagtttgattttgacttcttgcgttttaaagtgccaccgaatgaagacgaccgcctgatttcgcagcagttattgttgatgaaagttgcagacgaagcgattcatgatgccaaacttgcatctggcagcaaggttgctgtactggttgcaatggaaaccgagcttgaactgcatcaattccgtgggcgagttaatttgcatactcaaatcgcagccagcttaaatgcgcacggtgtcagcctatctgacgatgagtaccaagccctcgaaacccttgcgatggacagtgttttagatgcggccaagctgaaccaatacactagctttattggtaatattatggcgtcgcggatctcatcgttatgggattttaatggcccagcctttacgatttcagcaggcgagcagtcggtaaatcgttgtattgatgtggcgcaaaacctattggctatggagtcacgtcaagagccgctagatgccgtgatcatcgcagcagttgatttatctggcagtattgaaaatatcgtcctgaaaacggcaagtctcgctaaaacaggtcaactacttccgctcagtattggtgaaggtgcgggtgcaatagtactgcaggttgccgaccaaacagccacagactctgagccactggatttaattcatcaagcacttggtgctgtggacacaccatctgcggcaatatcaggttcaacagaacgaatcagcagtgattcccttaacagccacggggcgttaaacagctacgctacaatcaacagtttatcatttggtcacattagccaacttgaagccatcagtgatgaattactcacccctgcgggcttatctacaagtgatatcggcaagctagagctaaaccaagctccagacttaacccatattgattcagcgcaagcgctatcacaactttatagtcagtcagcaacaactcaagccaaatcatgtatcggccatacttttgccgcttcaggaatggcaagcttgctgcacggactgctcattcaaaaacaagatgcgcattcaaaccaaacggttcaacccttaaatacccttgtcgccacactcagtgagaaccagtgttcacagctactgatgagtcaaactgctgaacagatctcggctttaaacagtcgaattaatactgatattgggcagcaaaccgctaaaaaactgagccttgttaaacaagtgagcttaggtggacatgatatttatcagcatattgtcgatacgccactagctgacattgacaatattcgcgctaaaacggcaaatcttatccctgccgtaaccaatacaacgacgaacatgcttgagcgaggtcagtttgtgtctccacaactaactcctttagcaccaatgttcgacaagaataacgctatgacaacagagacttctatgccgttttcagatcgttctacccagtttaatccagctcctaaagctgcagcgcttaatgccaaagatagtgccaaagctaatgccaacgttaaagctaacgtgacgacagcaaacgtaacaacagcaaaccaagtgccaccagcacatttaacggctttcgagcaaaatcaatggttagcccataaagcgcaattagcatttttaaacagccgtgagcaaggcttaaaagtcgctgatgcgcttttaaagcagcaggtagcacaagcaaatggtcagccttatgttgcccaaccgattgcacaacctactgcagctgtacaagcagcaaatgtgttagccgagcctgtagcatctgctccaatcttgcgtccggatcatgcaaatgtgccaccttacacagcgccgactcctgctgataagccatgtatttggaattacgctgatttagttgaatacgctgaaggcgatatcgctaaggtattcggccctgattacgctgtgattgataactactcgcgccgtgttcgcctaccgaccactgattatttgctggtatctcgcgtgactaaactcgatgcgaccatgaatcaatataagccgtgcagcatgacaacagagtacgacatccctgaagatgcgccgtaccttgtcgatggtcaaattccatgggcggtcgccgttgaatcaggccaatgtgatttaatgttgatcagctacttagggattgattttgaaaacaaaggtgaacgtgtttatcgcttacttgactgtaccttaaccttcttagatgacttaccacgcggcggtgacacactgcgctacgacatcaagattaataacttcgctaagaatggcgacaccttactattcttcttctcgtatgagtgttttgttggcgacaagatgattctgaaaatggacggcggttgtgcaggcttctttaccgaccaagaattggatgacggtaaaggcgttattcgcaccgacgatgagattaagctgcgtgaaactgcgctaaacaatcctaataagcctcgctttgagccattattgcattgcgcccaaactgagtttgattatggtcaaattcatcatttgttaaatgcagatataggtggctgtttcgcgggcgagcatcacaaccatcaacaagcttcaggtaagcaagattcactgtgttttgcttctgaaaagttcttgatgattgagcaagtaggcaaccttgatgttcatggcggcgcatggggcttaggctttattgaaggtcataagcaactggcacctgatcattggtatttcccatgtcactttaaaggtgaccaagtcatggcggggtcattaatggctgaaggttgtggtcaattactgcaattctttatgctgcacattggtatgcacacgctcgttgaaaatggccgtttccaaccacttgaaaatgcttcacaaaaagtgcgttgtcgtggtcaagttctgccgcagcacggtgaactgacttaccggatggaaatcactgaaattggcattcaccctcgcccatatgccaaagcgaatattgatattttgcttaacggtaaagcggttgtcgacttccaaaacttaggtgtcatgatcaaagaagaaagcgaatgtacgcgctaccttaatgatacgcccgctgtcgatgcctcagctgatcgaattaattcagcaaccaataatattctatacccagcggcttcaaccaatgcgccactcatggctcaactgcctgatttgaatgccccaacgaataaaggcgttatcccactgcaacatgttgaagcgccgataattccagattatccaaatcgtactcctgataccctgccattcacggcgtatcacatgttcgaatttgccactggcaatattgaaaactgctttggaccggactttagtatttaccgtggtttcattccaccgcgcacaccatgtggcgacttacagctaacgactcgtattgttgatattcaaggtaaacgtggcgaattgaaaaagccatcatcgtgtatcgcagaatatgaagtgccaactgatgcatggtatttcgctaaaaacagccacgcctcggtcataccttattcagtgttgatggaaatttcactgcaacctaacggctttatttcaggctacatgggcaccacattagggttccctggtgaagagttattcttccgtaacttagacggtagtggtgaactattacgtgatgttgatttacgtggcaaaaccatcgttaatgattcaaagctattatcaaccgttattgctggtagcaacatcattcaaagcttcacatttgatttaagtgttgacggcgagcccttctacaaaggcagtgcggtatttggctactttaaaggcgatgcgcttaaaaaccagttaggtattgataacggccgtatcactcaaccatggcatgttgaaaataacgtccctgctgatatcactgttgatttacttgataagcaatctcgcgtgttccatgctcccgctaatcaaccacattatcgcttagctggcggtcaacttaactttatcgacaaagctgaaatagttgataaaggcggtaaaaatggcttaggttacttgtcggcatctcgcaccattgacccaagtgattggttcttccaattccatttccatcaagatccagtgatgccaggttcattaggcgttgaagccattatcgagttaatgcaaacttacgccattagcaaagacctaggtaaaggtttcacaaacccgaaatttggccagattttatctgacatcaaatggaagtaccgtggccaaattaacccattgaataagcaaatgtcgttagatgtgcacatcagtgcagtcaaagatgaaaacggcaaacgcatcatcgtaggcgacgccaacctgagcaaagacgggttacgcatttacgaagtaaaagatatcgctatctgtatcgaagaggcataaaggaataataatgactattagcactcaaaacgaaaagctttctccatggccttggcaagttgcgccaagtgatgccagctttgacactgccactatcggtaataaattaaaagaactcactcaagcttgttatttagtgagtcaccctgaaaaaggcttaggtatttcgcaaaacgcacaagtaatgactgaaagcataaacagccaacaggatttacctgtcagtgcatttgcccctgctttaggcactcaaagcctaggcgacagtaacttccgccgcgttcacggtgttaaatacgcctattatgctggtgcgatggccaatggtatttcatctgaagagttagtgattgcattaggtcaagcaggcattttatgctcgttcggcgcagctggcttaattccatcacgcgttgaacaagccattaaccgcattcaaaccgcacttccaaatggcccgtacatgtttaacttaatccatagtccaagtgagccagcactagaacgtggcagtgttgagctgtttttaaaacataaagtgcgcacggtagaagcttctgcatttttaggcttaaccccgcaaattgtctattaccgcgctgcaggtttaagccgtgatgcccaaggtgaagtggtaattgccaacaaggttattgccaaagtgagccgcacagaagtggcgagtaagtttatgcaaccagctcctgctaaaatgctgcaaaaactggttgatgaaggcttaatcaccccagagcaaatggcgcttgcccaattagtgccaatggctgatgacgtgactgcagaagccgattctggcggtcatactgataaccgtccattagtgacgctattgccaacaattttggcacttaaagataaaatccaagccgagtaccaatacaaaacacctattcgtgtcggttgtggcggcggtgtcggcacccctgatgcagcacttgcaacctttaatatgggcgcagcttatattgtgacaggctcaattaaccaagcttgtgttgaagcgggtgccagtgaacacacgcgtaaactacttgctacgactgaaatggccgatgtcaccatggcgcctgctgctgatatgttcgagatgggcgttaagctacaagtagtaaaacgtggcaccttattcccaatgcgtgctaataaactttatgaaatttatacccgttatgagtcgattgaagccatcccagccgaagaacgtgaaaagcttgaaaaacaagtcttccgctcgacccttgatgatatttgggctggcactgtggcgcactttaatgaacgcgatccaaaacaaatcgagcgcgcagaaggtaaccctaagcgtaaaatggcgcttattttccgttggtacttaggtttatcaagccgttggtctaattctggtgaagctggccgtgagatggattatcaaatttgggccggtccagcactgggcgcgttcaacgaatgggcaaaaggcagctatttagatgattatacccagcgaaatgcggtagacttagcaaaacacttgatgcacggcgcagcttatcaagcgcgtgtaaacttacttaccgctcaaggtgtggcactgcctgttgaattacagcgttggagcccgcttgatcaggttaagtaagcctgccaagcgtcatcaagctaagtcatttggatataggtagcggtaatgagcgaaacacaaaaacttgatttttcagtggttaatggcacaacacttgagtcgttcaaccaacaaaaaaatctgattaaacgcatgctaaaaggcaacagcgcaacatgtgctgaatgtaacaagccactaacgctgcaattaccgcctaatactaaaaatgccaaacctgccgaaaaagcacctgggatatactgcgcaaaaggctgcacagatattgaactggatatggaagctgtggcacttttaaaataatacgatgaaataacccatagattatttcatcattaccatttaaaaaaggcatcgaaagatgcctttttattgcaattaattgaccactttatcaagtggcgacttacctaatcactcaccaaaataagttattcagaatagtgaatttagaattgagagtttagggaatgctgttactgatacggttcaaattaggtaattaaaatatacttcattgcttcacggttcctgcacggtttctgcactttaatcacataacattaaaaactcataatagccattatcaactacgggttaacttaggagtttacttatgttcagtccccttctctattcgctttttcaaacgggatgtaaaccatttcggcaactattaattataccgcttactagcttatgcctattaactgcttgtgatagctcagatgataccagcagcgaagagactgtaataacagtacctgacactgaaattgaaacaccggttgaggagtataacgatactgattttgaagcaagcgattggaccgatgacacccatagcaaaagtgcagatgccaactttgatgaagtatttgctgacaatgaagtaaaacgccttgatgtggtggtcactgaagatcgctggaccatcatgcttaacgatatgactgatacttatggcacttttggtacaacgactaattcaaacaaccttgtagatacagatgacaaccccattatggtgccagctgatatttattacgaaggcaaacagtggtatcgagttggtatccgttttaagggaaactcgtcactgcaaaccagctggcaacaaggcgtactcaagttatcttttaagttagattttgatgagtttgaagactactacccacaaatcgacaatcaacgattttatggctttaaaaagttaagtcttaaaaataattacgatgatgagtcgcagttacgtgaaaaagttgccgccgatgtatttaaagatgcaggtttagccgtctctcacaccgctttttatactttatatatcgaccatggtgatggccctgaatactttggcttatatacccttgtggaagaagtcgatgacacggtaattgatactcaatttagcagtgatgatggtaacttatataagcctgaggatgatggtgcgacctttattgaaggatctttcagtgaagacagttttgaaaagaaaaccaatgaagatgatgaagattggtcagatattttagctttattcgacgcattacatgatgatacagcgacttccgatcctgttacttggcgtgaaaaccttgaagctatatttgatgttgatgtgttcttgaaatatctcgcagtgaatggcgtaattcaaaactgggatacttacggattaatgccccataattattatctttacaacgatccagacacaaacaaattaacttggatcccatgggataataatgaggcattacaaacgggtaaaatgggcggtgcattagaacttaatttctctgatttagactcaaattcttggccattgatagccaaaatctatgctgatgacacataccgggaacgctataaccagtatttatctgacgttattagcgatagctatgaaaccaataaaatgcaggcaatttatgacagttactcagcattaatagagccttatgccacaacagagttaacaggttactcatttttagagtctgcaaatgacttttatcaagcagttgatgatttatctgaacatgctgaaagtcgaacagacgccgtaatcgattacttaaacacgcaataggttgtagattttttctgtcattttgcagatacaatgaaaacgaaagcagcactggctactttcgtttttgttgctatcaattcaaaaccgtttactagcgcacactttcttattaaaaaataacaccttaacaagtcattgacctaaatcaaacataatgtgaaaaagctaaggcactatgcctctttattttttagtttggttatttccaatgagtgatatcaaggcaaacaatatagagcaaccgctgacggacgagtgcattttactttctaccactgatttgaatggtaatatcaaatacgccaatcaagcctttgcagatatctctgagttcacgacagatgaactccacggaaaaccacacaatattgttcgtcaccctgatatgcctaaagcagcttttgaatccttgtggcaacgggtcaaagacggaaaaccttggtttggtatcgttaaaaataaaagcaaaacaggcaagtattattgggttaatgcctatatatcgccagtctttgaaaacggcaaaatgcatgaactacagtctgttcgacgtaaaccttgtcgtgaacacatcaattccgctgaaaaaatttacaaacagttaaatcaaggtaaagcccccagagaaaccacagcaccactgcttagctttacgggttcactttgcctttgggcaaccgttatttctttgataggggtagtgtcttcgctcttcatgccaactttggtcgccgcttttttcattcccttaatggctggatttgtcatgtattacttaacgaggccgttaaaagaacttgaaaataaggccacaaaaattatcgacgacccaattgcttgcgggattttttcatcgagtcaacatgagttgggcaaaattgaattagccttaaactacttagtcactgaaatgggtggtgttgtcggcaggatggcagattcagccacctccattagcgaagaaagccagcaacttaatcaaactatatcgaccactcgtgaacgggttaaagaacaaacacaccaaacccgtcaggccgcaacagcaatggagcaaatgacggcaagcttcactgaagttaatcaaaatacccgcaatacagcacaagaaattaccaccagccaagaggctgctagtaaaggtcacgatagtatggacaaagtagtcaatgcaattggcgagcttagaaaagaagtggttcatttctcaacggtggtcaatacaattgaaaaagacagccaatcaatcgcatcggtcctaggagagattaaaggcatcgcagaacaaactaatttattagcgttaaatgctgccattgaagcggctcgagcaggtgaaactggccgtgggtttgccgttgtggcggacgaagtaaggcaattatcaattcgcaccagtgattccacatcagaaattgaacacatagtcacgaactttcaaaaaaccacaaaggaagcgactcaagcaatggagtctggtcagttgcaagccgatttatcagtatccttagcagaagaagcggatgacacctttgctcagctccttaactcaattaatcgcatacacgaaatggctgagcttaactcttcagccatgaaccaacaaacagcggtcgcagaagaaattagccaatctattttacagatagatgagatttcaaacctgaccttaattcaaaccgatgacacccaaaacaagtgtgaacaaatgagccgattagccaataaaactcgtcatttatcgagacaattttggacgcaaacaatcgaacgcaccaaataaatacctccaatattacccaaagcgtcataacctacatgttgattatgacgcaatcttgctcaacactgattaacttccccatgtttgcagataacgcgagatttagcggctgattgactattgccccctctttctgattgtcattttttcctgttgtgacagtttattttttgataagactttttaatttaaaaaatgccctaatatcatatatacagttaacgttaagccatgcttataaagccgtttaaagcgattcaaagtgagggtacacaatgacaaacgaatttattccacctaaaaaatgggtaatggaagaggaaaatggcggcaagtttgccagtataaaccgtcctgactctggtgcgcgctatgataaagatttaccggttgggaagcatgcactgcagctttactctatgggcaccccaaacggccaaaaagtcacgattatgttggaagagctgttagccgcagggatcactgacgcagaatatgatgctcacttgattagcattggtgatagcgatcaattctcatcaggttttgttagcgttaatccaaattcaaaaataccggcattattagataacagtacctcaacgcctattaatgtatttgagtcaggcgctattttactttacctcgctgaaaaatttggctgcttcttaccaacagatttagctgctaaaacccaagtcatgaattggttgttttggctgcagggctcggctccttatttaggtggcggttttggtcacttttatgcttacgcccctgaaaagtttaaataccctatcgacaggttctctatggaggccaagcgtcaacttgatgtacttgacaagcaattagctaaacaccgcttcttgggtggtgatgagtatagtattgccgatattgcgacatggccttggtacggaaatttggtgcttggaaacctatatgaagcagcagagtttttagatgttgaaagctaccctaacctaatgcgctgggcaaaagacattgaacaacgtccagctgtcgcgcgtggcagaatcattaatcgaacctggggggaagagtgggaacaactagcgaatcgtcatagcgccgaagatattgataatgtgcttaaacgtcagccataacactcacaatttctcaatccattggtagatcactcaattttgataatgtgagcctttacctttgatgtgattcactctcattgggaatgaagtttgataaagcggtaggcacaccatcaagtgcttatcgcattattgctaaccaacaacccctttaccgattaaccactttcaagcttgttccaacaacataagcacgtcggctgtacgtctggcggtaaagtaatgataaaaccacaatgcgggcaaaaatccccaatatttaaacggacataagattgtgtttgcttatacatcagcatcgctcttcttttcgattatattgaggtgaatacatcgccattagctgtgcttctacagcaccccttacacaaacaggctcaccatttagcggactaggtacagttacgttagtcgcaatccatagctccatatcacgtattaactcctctttaactaacctgccagccgtaccatgtgaccaaatacgttttccaagtagaccactctcgccgacatataaaacctgatctcctttcttgaaaaaatacacccccgaaatgtctcttggtaacagagaaaaccagtgctttcttgttgcatactcattaccctcaaagtcatataagccataagtttcgctattacgattaacaagccatgcttgagatcaactgatattagcgatatgagtaaatgtaatactgcccattttaaaggtattcatctacgacctcagcgcagttaaacccctggtacatctggccatcaggcctcaacttcgaacttgttacagcattatcactaacaaacttggtataaattgtatctactcttttaacaggcttaccaaataacactcgagtatttcctccgatagcagataccagtcgactacctagcatctgatgttcttcagtttctatctcatctaatatggccacaacttgataagccactggaattttacggtttgcattgatgacataaacccaatctccttttgagattgaacaaaagtcatcccagccatgttggccaggtgctaaatcgaaaaaagcattgttaccaagcgatgcatatatttttcggtgtggacgatcagctatatttgatacaagaaattttcgcataatgaacaaaggcacttaatacacatgtgtatatactaattaagtttccctacaaagtaaaccgtactaagtacctttattgtttatttcaatatagatcatattcaaataacgctaatcataacgacttttttattgatttcattgaattttaggcgcaaagttaactatgtaaaccagctaattagaacgcttaaagagtaaaaagcgcacactagcaacacagataaaagcaaaattgcgccagtactatcagcaccttcatatgaggtaaatatgaacaagctactaatacttagagcagtgacgaggatttatgacaccttcaacctctgcaaaagcacccactttaataccagccaactaaacttgttagcgacagcgaatcacctcatcgctgcatgctttaacagcaaaagtccagctaacgctaaaatcaaatcagcaagtatcatcatttgttacttatttaacggcattgtttttagcgtacatgcaacggatgagcaccttaacagtacaaggcatcttcaaacgatttccccgcttaaaaccgctttgcatttggagacttatttaggcggacatagtacaaatttagctaacaaagccgcactttcgtttgagttcggccagagaaatagtcagcatgtttgccatataaccacaacagaagagcatttaatgcaatccaataatttactggaaaacattaatttaagtgaaaaacatttcttctttgactgtcaaattgataatgatttttatgtattatctaaccaataccgtacttatgcccaagtgataattaagcaacctgacatcaactttccaatgtcgatgcatatagaggcgaaacttgtcacaattgatggcaagctgctcaatgtcaccagtggtgatatctcacttaaacggaaatagctcacatggaatttgacacaataagagattatttactgactaaaccttttgctacagaagactttccattcggagaatctactcacgtttttaaagttcactcgaagatgtttgcactaatgtcatggcgaaatgatgctttgatggttaatgtaaagtgcgatcctgaagactcattcgccctaagagagatatttagcaatattacgacgggatatcatatggacaagaaacattggatttctatctatttacagtcaactgggagtgataaatctaaagaatctcgattaattccagatggtgaggtattgcgcattattgataattcatacctattagtcgtcgacaaacttcctaagaagcaacaaacagccatcaaactgcatttataacaaacaaatcaaagcgctttatagggtttgagcaagactatttttcagaaagcagagctgtgtgcactattttttcgatagtattgtcttgctcacctaagaactgacaaccaaactcgacaccattttcgaataatttaacattacacactctggctttaatggtgaggttttcttgttctgtagcctctatcacgatttcaatctgctctccctctgttaactcatcttttccaccttcactaacttcaatatgacaacctgaaagtgaaacatcggtgattttaacttgccattggttatcacctaaagcgatattggcggttaaatctgtcaacacacgtttggtcgaacgtaaattgtgaataaccatattatctgggaaattcaataccataatacgagatggctgactcaaggtttgtttgattgttgaaataaatgcgattacagatgcctcatgaccttccactaaaccacgaacagtcacttgtgagccctgagtaatgtactggctgtagcctcccaatttatttgcatctggaaattgaattagtatgaattgttcaggtagataaccgataaaaatggtacgaaaacgcccttttttacctgcaggagtcacaatatcaatattgacaggcgtaccagccaataagtatttaaattctttagacaaaccctctttagtattgatttgttttgtggtcattttaccttccctgaaccttttatttcccaatcaaagattagcacaagatttaacatacacaacagtgagttaaccttaattaaatgttattcatgtgcttgcacctcttgtatctagaggtctatggtgaatatcacaaggttaaggtttttgatgtaaaacataaaagacattgcaccaaacctgaatattgacggtcgtcagattcagtcgcctcagccgttgacataaggtaacggagttaacatatgagaaatctagaattattcagcacagcatctatcgatcacttactttggtctaccagcactgactcacccagcttagactctccagcgttagacgtatttactgattttgatgtagcacgtcctattgtcgttgatgcatccaccagcgcagtggccacagcaataatcatggaacaaacccatgcatttatgagattagttgttgataagaataataaatttttaggggtgataacgctgcaagaattgtctgaccataatttatttgttaccgcgaaaaagctagaccttactgtagatgagcttttagtcacagaagtgatggtgccaagagaagagctacaagcgtttgactatcaacaaatttcaacagccaaagtcagtgatatagtcaggcttttgcaacaaaataatttgcaccacatgctagtcatcgatcatgaattgcatcatatccgagggctgattgcagcgagtgacttagccagaaaactcaatatgccaatagaaatacatcaacggccttctttcagccaaattttctctaatgcccattaatgattttgcctaaacgatataaatcacggagccacttacctgacaaatctcaggtaagtgacgataaaccttattgaatatacgcagaaactagccttgctgtgttagttggctttcttgttcaacaagctgattatcgaaagcaacacactgatttttaccataagtcttagcttgatatagggccaaatccgctttttgaataatctctttcgctgaggtgaagttgctaggtatgcaagaagtaaaacctaaactcaaggtgacgattttactttttgatcttgggtgcgggatgccgagttcggcaattttcaaacgaatatcttcagcgagttgcgacacactttcttgctgtccgtaacaaataatagcaaactcttcaccgccataacggcataccacatcggttgaacgcacacatacctcagctattgcttgcgatacttgtattaagcattgatctccttggtagtggcctaagaaatcgttataagctttaaaacaatcaatatcacacatgattaatgacactaattgtcgctctcttcgtgctagattgataataaagtccaattgagaatcgaactctctgcgattgttcagccctgttaatgcatcaagctttgaaagcttaaacaatttagcactcgtacgttcacgctcaataatcccaaaaagtaattgtgcatttccgcaatcgtctcgaagtattgctctcgctttactcgtaaagtaaaggatctcaccttggttagcgtcataataaggaaaacgattatggtattcatcgatacgtcctaagcgcaagtcacagtaatcttcaaaaattcgcttagctttatgggcatcttttaccgcaatatttttattgtaatccccagcgataggacaagtcttactaacagaatgttgaagggtatttgagtctaaagagaacatgtcacgcatgttactgttgcagtaaaaaacattactattatcttctaagtctattagccaccaggaaacacctgaaaagcttaataactcttgataaagcgtataatatttttcaattcgcttatttggaaacgtcataattgattagccactttgttcaagctaaccattagtcacttacgcaactaactttccctttagcaaaatgaatcagcaaaactactatgattatagaccctgtttacgtaatttcctgtttgcctctcatttagctcaaaacaatgtcgttaataaatgccgctaataaatgcattaaaccgctgtccacctatgttcgatacacggctttatttgggatacttgctcagctaactgctcttgtgatgaataatcgacattggcccaaagcttaatctcaaacaccgcccctaaagcaacctggccaacgcctttaggtgtacctgtcatcacaatgtcgccatccactaacgtcataaattcattcaccgaagctagaatatcgtcagcactgtacatcattaaatcgctatgaccgagttgcctgacttcaccatcgattgtcaattgaaagcaaaatgtagctccggcagttaacgacaatgaagataaactgacaaaatcactaaatagagccgagccgtcaaatgccttagctcgctcccatggtagctgttgtgatttaagtttggactgcaattctctcttggttaggtctaatcccacccctaccccatgaaacatcccattacgcactgaaaaacatagctctgtttcaaaatgaatcggctcttgatgaaatgagatcagctgcgtggaaatcgcagagttaggttttaaaaaaaccaccatatctgaaggcacctcattacccagctcatggatatgatc

SEQ ID NO: 70 - protein, 2787 aa, Sh. japonica
MSQAPTNPETSSQDNNESQDTRLNKRLKDMPIAIVGMASIFANSRYLNKFWDLISEKIDAITEVPDTHWRAEDYFDADKSTPDKSYCKRGGFIPEVDFNPMEFGLPPNILELTDTSQLLSLVIAKEVLADAGVTSEYDTDKIGITLGVGGGQKINASLTARLQYPVLKKVFKSSGLSDADSDMLIKKFQDQYIHWEENSFPGSLGNVIAGRIANRFDLGGMNCVVDAACAGSLAAMRMALTELVEGRSEMMITGGVCTDNSPSMYMSFSKTPAFTTNETIQPFDIDSKGMMIGEGIGMVALKRLEDAERDGDRIYSVIKGVGASSDGKFKSIYAPRPEGQAKALKRAYDDAGFAPETVGLIEAHGTGTAAGDVAEFNGLKSVFGENDSTKQHIALGSVKSQVGHTKSTAGTAGVIKAALALHHKVLPPTINVSKPNPKLNVEDSPFFINTETRPWMPRPDGTPRRAGISSFGFGGTNFHLVLEEYSPEHSRDEKYRQRQVAQSLLISADNKAELIAEINKLNADISALKGTDNSSIEQAELARIAKLYAVRTLDTSAARLGLVVSSLNELTTQLGLALKQLSNDAEAWQLPSGTSYRSSALITINANQKTTKGKKAANTPKVAALFAGQGSQYVNMGIDVACHFPEMRQQLIKADKVFASFDKTPLSQVMFPIPAFEKADKDAQAALLTSTDNAQSAIGVMSMSQYQLFTQSGFSADMFAGHSFGELSALCAAGVISNDDYYQLSYARGASMAASAVDKDGNELDKGTMYAIILPANENDAANSDNIAKLESCISEFEGVKVANYNSATQLVIAGPTQSCADAAKAIAALGFKAIALPVSGAFHTPLVGHAQKPFAKAIDKAKFTASKVDLFSNATGDKHPSDAKSIKAAFKQHMLQSVRFTDQLNNMYDAGARVFVEFGPKNILQKLVEATLGNKAEAVSVISINPNPKGNSDVQLRVAAMQLSVLGAPLSSIDPYQAEIAAPAVPKGMNVKLNATNHISAPTRAKMEKSLATGQVTSQVVETIVEKVIEKPVEKVVEKIVEKEVIKTEYVEVATSGATTVSNVAPQAIAPHASAQAAPASGSLEAFFNAQQQAADLHQQFLAIPQQYGDTFTHLMAEQSKMVAAGQAIPESLQRSIELFHQHQAQTLQSHTLFLEQQAQASQNALNMLTGQTPVTAPVVNAPIVNSPVVEAVKVAPPVQTPVVNTPVVPAVKATPVAQPAAMAAPTPPVEPIKAPAPVAAPVVSAPVVPTPAGLSAQTALSSQKVLDTMLEVVAEKTGYPTEMLELSMDMEADLGIDSIKRVEILGTVQDELPTLPELSPEDLAECRTLGEIVDYMGSKLPAAGAMNSDTANATHTAVSAPAASGLSAETVLNTMLEVVAEKTGYPTEMLELSMDMEADLGIDSIKRVEILGTVQDELPTPPELSPEDLAECRTLGEIVSYMGSKLPAAGAMNSKLPASAAEVAQPQTAPVQAASGLSAETVLNTMLEVVAEKTGYPTEMLELSMDMEADLGIDSIKRVEILGTVQDELPTLPELSPEDLAECRTLGEIVDYMNSKLPAAGSAPVASPVQSATPVSGLSAETVLNTMLEVVAEKTGYPTDMLELSMDMEADLGIDSIKRVEILGTVQDELPTLPELSPEDLAECRTLGEIVDYMGSKLPAAGAMNTKLPAEGANTQAAAGAAQVAATQTSGLSAEQVQSTMMTVVAEKTGYPTEMLELSMDMEADLGIDSIKRVEILGTVQDELPTLPELNPEDLAECRTLGEIVSYMGGKLPAAGAMNTKLPAEGANTQAAAGASQVAASTAETALSAEQVQSTMMTVVAEKTGYPTEMLELSMDMEADLGIDSIKRVEILGTVQDELPGLPELNPEDLAECRTLGEIVSYMGAKLPAAGAMNKKQASVETQSAPAAELATDLPPHQEVALKKLPAADKLVDGFSKDACIVINDDGHNAGVLAEKLVATGLTVAVIRSPESVTSAQSPLSSDIASFTLSAVNDDAISDVIAQISKQHKIAGFVHLQPQLTAQGALPLSDAGFVAVEQAFLMAKHLQKPFAELAKTERVSFMTVSRIDGGFGYLNTAELAKAELNQAALSGLTKTLGHEWPTVFCRALDITPSFEAVELAQAVIAELFDVDTATAEVGISDQGRHTLSATATAQTRYQTTSLNSEDTVLVTGGAKGVTFECALTLAKQTQSHFILAGRSEHLAGNLPTWAKSVIAAAPNVSEVNTSQLKAAAIGFIQSQGNKPTPKQIDALVWPITSSLEIDRSLAAFKAVGASAEYISMDVSSDAAIKQSLAGVKPITGIIHGAGVLADKHIQDKTLAELGRVYGTKVSGFAGIINAIDASKLKLVAMFSSAAGFYGNTGQSDYSMSNEILNKTALQLAANYPQAKVMSFNWGPWDGGMVSSALKKMFVERGVYVIPLDKGANLFAHSLLSESGVQLLIGSSMQGSSSADKTGAAVKKLNADSSLNAEGSLILSFTTPANRVVNNAVTVERVLNPVAMPFLEDHCIAGNPVLPTVCAIQWMRETAQQLCGLPVTVQDYKLLKGIIFETKEPQVLTLTLTQTESGLKALIASRMHRDPMDSLLRPQYQANLVINEAVINGQTLTTQPTIVADAQQLASAGKVISTDSELYSNGSLFHGPRLQGIKQVLIADDTQLVCNVELPHISSADCAGFAPNLSIGGSQAFAEDLLLQAMLVWARINHDAASLPSTIGKLTTYSPFASGDKGYLVLSVLKSTSRSLTADIALYHQDGRLSCTMSSAKTTISKSLNEAFLAPAKAIADLQESV

SEQ ID NO: 71 - protein, 759 aa, Sh. japonica
VSTQLTAKTAAINSIRIALKLVANDQTSFAPAQNADDIFSAIKPCSLAQVIGESAIDLEIDVSSLDAGIDNLATASQQTLSFSDYFAQAIAHIEQQHTVLLSHPAIPYRVLMMPAIVAAKHRCHPHAYLTGLGEADDMQCAMQNALAQAKREHITPTLVDVTELTCYKDKFTQLVMLISRIAARRLPDTTLPTVTSDKQNNSNQANAKYWFTQMHQNRVASFNFTENGKQHAAVFVQGTELAQASSMLDENRLFFPLAANTSACMIQSLHELLVALNRLNQQQSNPLDSQRLLNKPSHVISLMLNYLKAFDQTKSLSAVIIANSVVTAIAEIEAMLAKISTASDDTSGSINELEYKTPSGSCLTITHHEALGRSGVCFVYPGVGTVYPQMFAQLPQYFPALFAQLERDGDVKAMLQADCIYAENAKTSDMNLGELAIAGVGASYILTKVLTEHFAIKPDFAMGYSMGEASMWASLNVWKTPHNMIEATQTNSIFTSDISGRLDCVRQAWQLEQGEDIVWNSFVVRAAPTEIEAVLADYPRAYLAIIQGDTCVLAGCEQSCKALLKQIGKRGIAANRVTAMHTQPAMLIRDNVQAFYQQALHDQDVLDAQASSIKFISAASQIPISLTSQDIANSIADTFCQPLNFTKLVNNARHLGARLFVEIGADRQTSTLIDKIARTAANTDSHLNAPLSAIAINAKGDDQTALLKCIAQLISHKVPLSLQYLTENLSHLLTASITRENRQQSQTAQLAPQLEGEQS

SEQ ID NO: 72 - protein, 2019 aa, Sh. japonica
LSSQSNVPKIAIVGLATQYPDADTPAKFWQNLLDKKDSRSTISQQKLNANPADFQGVQGQSDRFYCDKGGYIQDFSFDANGYRIPAAQFNGLDDSFLWATDTARKALNDAGVDITNSQDNAILNRTGIVMGTLSFPTAKSNELFVPIYHSAVEKALQDKLQQPSFTLQPFDSEGYSKQTTPASLSNGAIAHNASKLVADALGLGAAQLSLDAACASSVYSLKLACDYLHTGKADMMLAGAVSGADPFFINMGFSIFHAYPDHGISAPFDSNSKGLFAGEGAGVLVLKRLEDAERDGDHIYALVSGIGLSNDGKGQFVLSPNSDGQVKAFERAYADAAMHDEHFGPDNIEVIECHATGTPLGDKVELTSMERFFNDKLNGSHTPLIGSAKSNLGHLLTAAGMPGIMKMIFAMRQGMLPPSINISSPITSPNQMFGPATLPNDVLPWPDKAGNRARHAGVSVFGFGGCNAHLLIESYHGQTSTAPAANTINAQLPMHITGMASHFGPLNNINRFANAINQQQTAFTPLPAKRWKGLDKHPELLQQLGLAQTPPTGAYIDQFDFDFLRFKVPPNEDDRLISQQLLLMKVADEAIHDAKLASGSKVAVLVAMETELELHQFRGRVNLHTQIAASLNAHGVSLSDDEYQALETLAMDSVLDAAKLNQYTSFIGNIMASRISSLWDFNGPAFTISAGEQSVNRCIDVAQNLLAMESRQEPLDAVIIAAVDLSGSIENIVLKTASLAKTGQLLPLSIGEGAGAIVLQVADQTATDSEPLDLIHQALGAVDTPSAAISGSTERISSDSLNSHGALNSYATINSLSFGHISQLEAISDELLTPAGLSTSDIGKLELNQAPDLTHIDSAQALSQLYSQSATTQAKSCIGHTFAASGMASLLHGLLIQKQDAHSNQTVQPLNTLVATLSENQCSQLLMSQTAEQISALNSRINTDIGQQTAKKLSLVKQVSLGGHDIYQHIVDTPLADIDNIRAKTANLIPAVTNTTTNMLERGQFVSPQLTPLAPMFDKNNAMTTETSMPFSDRSTQFNPAPKAAALNAKDSAKANANVKANVTTANVTTANQVPPAHLTAFEQNQWLAHKAQLAFLNSREQGLKVADALLKQQVAQANGQPYVAQPIAQPTAAVQAANVLAEPVASAPILRPDHANVPPYTAPTPADKPCIWNYADLVEYAEGDIAKVFGPDYAVIDNYSRRVRLPTTDYLLVSRVTKLDATMNQYKPCSMTTEYDIPEDAPYLVDGQIPWAVAVESGQCDLMLISYLGIDFENKGERVYRLLDCTLTFLDDLPRGGDTLRYDIKINNFAKNGDTLLFFFSYECFVGDKMILKMDGGCAGFFTDQELDDGKGVIRTDDEIKLRETALNNPNKPRFEPLLHCAQTEFDYGQIHHLLNADIGGCFAGEHHNHQQASGKQDSLCFASEKFLMIEQVGNLDVHGGAWGLGFIEGHKQLAPDHWYFPCHFKGDQVMAGSLMAEGCGQLLQFFMLHIGMHTLVENGRFQPLENASQKVRCRGQVLPQHGELTYRMEITEIGIHPRPYAKANIDILLNGKAVVDFQNLGVMIKEESECTRYLNDTPAVDASADRINSATNNILYPAASTNAPLMAQLPDLNAPTNKGVIPLQHVEAPIIPDYPNRTPDTLPFTAYHMFEFATGNIENCFGPDFSIYRGFIPPRTPCGDLQLTTRIVDIQGKRGELKKPSSCIAEYEVPTDAWYFAKNSHASVIPYSVLMEISLQPNGFISGYMGTTLGFPGEELFFRNLDGSGELLRDVDLRGKTIVNDSKLLSTVIAGSNIIQSFTFDLSVDGEPFYKGSAVFGYFKGDALKNQLGIDNGRITQPWHVENNVPADITVDLLDKQSRVFHAPANQPHYRLAGGQLNFIDKAEIVDKGGKNGLGYLSASRTIDPSDWFFQFHFHQDPVMPGSLGVEAIIELMQTYAISKDLGKGFTNPKFGQILSDIKWKYRGQINPLNKQMSLDVHISAVKDENGKRIIVGDANLSKDGLRIYEVKDIAICIEEA

SEQ ID NO: 73 - protein, 542 aa, Sh. japonica
MTISTQNEKLSPWPWQVAPSDASFDTATIGNKLKELTQACYLVSHPEKGLGISQNAQVMTESINSQQDLPVSAFAPALGTQSLGDSNFRRVHGVKYAYYAGAMANGISSEELVIALGQAGILCSFGAAGLIPSRVEQAINRIQTALPNGPYMFNLIHSPSEPALERGSVELFLKHKVRTVEASAFLGLTPQIVYYRAAGLSRDAQGEVVIANKVIAKVSRTEVASKFMQPAPAKMLQKLVDEGLITPEQMALAQLVPMADDVTAEADSGGHTDNRPLVTLLPTILALKDKIQAEYQYKTPIRVGCGGGVGTPDAALATFNMGAAYIVTGSINQACVEAGASEHTRKLLATTEMADVTMAPAADMFEMGVKLQVVKRGTLFPMRANKLYEIYTRYESIEAIPAEEREKLEKQVFRSTLDDIWAGTVAHFNERDPKQIERAEGNPKRKMALIFRWYLGLSSRWSNSGEAGREMDYQIWAGPALGAFNEWAKGSYLDDYTQRNAVDLAKHLMHGAAYQARVNLLTAQGVALPVELQRWSPLDQVK

SEQ ID NO: 74 - protein, 303 aa, Sh. japonica
MSYCYYKCEFGLSPLPTIQLFFCPLDTNLLDEKTVSTVRSWLSDAEINKVDRFIQQAAQQQGLMVRGYLRSVLSNFANIEPDDWQFEYGEKGKPRLSAVQYKQTGLQFNLSHSGNWLLIGVIHSKEDASMPIQLGVDIERRRESTNIHSILHHYFSKPEETALLALPESQQRERFFDLWALKESYIKAKGLGLALSLKSFAFDLSAPSLANLTIDDQLLPIQHDISLSLLKPTDVDELEQTNDVESFYEVSPLWQCCLGKLNNSYRFAVSVGEFAFGEKPLTLQLKAKKISWHEQIKMFIKTN

SEQ ID NO: 75 - DNA, 38794 bp, Sh. olleyana
gatccagtgttattcaaccaaattgaagcattgaatactccttatccttttccaattcaaggccatgctcaattcgccatcgtgttttggcgagaagatgagataccgtttatttggtttttaaagcttccgcttgatgaacaagggttattgtctccagctcaacgtagccaattcatcaaaatgatcctcgaagccttaggccgagatcctaccaaagcgctttctgatgaagaacaagagcgttatgctaatcatccgttcagcttcaaaccgagtcaggagaagctagccttatttaacgcattagtaaaaaaacagttaagccaacaagcctcggcgcagtacgaatatgctgctcagtactttgaaaatttgaatgaaaaaaacgctcaagatgacagctggcagcaactgggtttacaaggcatcgccgatgtctgtgtccgcttagataagtttgaccatgataagcatattaatacggcaatgaagcttgctcccttagaagtacaagccgcaatttgccaatgtttagaacatgttgctgtttcaaatacattagctgaaaccttatacgataatttgtcatctgctgaagtggaacataaacatatctaccttcgcgctcttgcttcacagcctgaattgactcaaaaagcgattcagcaactggttaatttacagcaactcgatgagaatttattaatcactattgcagcaagaagttggacggctttaaaagatgatgcaactcgcaaactttatcttgaagtcttagctaaccaaccacaaaacttctttaatcaagtttttgctgatatcgtagctattccaagtctacggaactcactgctacttgatttaagaagtgctgatcgtagtgaaaaactttcttccgccatcggcggattatttagggccgttagccaatgatgtcagactttattttaatcgttgctgttgtggttgttgctgcattcttttggcagttacgccagatggctgaaatcagtcgccgatatgctgagagatcttgtgccaatcaaaaagtacaattactcgcgattgcgatggaatcagctagacctagtattggcggttcaacaggtttatgttggcgagcaaaatttatgtttgaattcagcaccgatggtattaaccaataccgcggtcatatcaacatgcacagcaaaaaaatagagaaaattaattggcctattttccctgagcccgaatggatggatgcgccaatggcaaaaggcaaattcggtggttgtggcggcgcatcgagctgtaactcaggtaagtgtcgttaagcctcaacaactgcctaatcagtgagtcattgtagagttaatgtcactcgtatttactcaaaatatagttacaacaaaactgattattatcgtaataaaataagcgctattaggagaaattcactcttaatggcgttttttattggctaagtgattttttgtacgattgttggaaaacacacaagtcaaaaaatacttcacgtatggttatatatttagcccaaaagaaagaccgcggcaataaattgtcgcggcctcttgtacttttgttaagccatccagctatatctgtgctccctgcaccatccatgcgtctaacttgctccgtgcgctatccttattctatccttgatgttccatgtacatttaagtactgtccttcttactcgattatcctttgaccgagcctgctcaaatccttaagcgtgtcctttaattcgtccgtggttttcttccatgacatccttgattcaatttactgcatccattgcaatcactgttttccttaacagctcaaatccattttattgatgtccaatttataaaatccatttaaccataaagtctttcatcatcttcgatgtcagtgtcatccataaacactatcgttttccttaacgacgctttatcgtccacttaattaatgtgccttagtcatcatcctgatgagcaacaacaataattaaggttcatcctgagcaagccagcacaataatctattgtaacgctctgttgtaacaatctcatgttacaaccacctgcaaaaatcctattcagctgcagtctgaattcaaactgctaaacacttcctgtgcttatttgcttccttgtgattaattttaatcgatatgtgagcaaataaatatgcacaaaacacacaattaacatcaacccaacaaacaagcttggcacccataaaattaaactatttaaatacagtaacttaaataaaaacacttcaacatcgttatggttaaagcgtttaatctcacaacttttgtgagatatatctcacaaagagtataggaaagacagaaggtaagtcttttggcctattcacacatttaacatttgttaggtaaaagtgcataaatattgatttgaactgaacataaaaaagcccgaccttataaataaggtcaggctcattttactctttgttagctatcctgctaaattgtgctccctgctccatccatgcgactatatgtgcttcctgctccatttatccatttcaactcaatttccttgtattgccccaaatagagcattacatgagttttcattcctttgaatcagtctatccatttgactgaaagtcttactcctagatataccatcctggtatttgcttcctgcaatccttcatcttcctgatgagggtcatccttgtttcagttaatcattaactgagcttatgcccattccttgagcgtgtccttgtttcatcctgaattggttgttactcacccagcatttactcgataaataactaaattcacttaagcagcaatattcacttaaaccaaatagttaattaactgttcttgtcttgcggctacttcctgtaactcactaagttaatatattgattgcttaatgagttcattgtaataaatggatgaaatagagataggtaaaaaacgagcagaaacaaaaacttcacaaacctgaaattcagaccaaaaactcaagcacttgttttatatccacaaattaataaaaaagtaagatattgagtatttgggctaaacgaatacctacatcaatgtgagataagtctcacaaacggaagtaacagttagcttgaataatttcccaacttaaactgtttttttaacatttgtgcaaacatcacccaatcagctaatagactataaaacgggtactcgaatgttgctggtcggtttttctcaaacacaaaatggccaacccacgcaaaaccatagccaatcacgggtaaaagccacaattgccaccactgctgattaatgagcgttataacaatcaatattatgattaatccacttccaacataatgcagccttctacaagtggcatcttgatgttgtgataaatagaaagggtaaaaagatttaaagtcttggtattttttttcgctcatcttatcgtctccacttatatattattgtttttgagaaagatgctaaacagaactgtagacaacatatggttcacaaaatgacagttttatttacttggataaatgagaatttcaccatcgacactgccaattgttaattcagacaaatgattaaagccttcacgagcaaataattctgcatgcttagggttattcacgaaaacaccgataccatcaagttctggctgctcatcacaccaacttaacactgcctggatcagcttagcgccattacctttactttgctcaattggcgataaagcaataaattgcaaaataccatactgcttactcggcaagctttctaagatactgtgctcttttttcatgagcgcttgggtcgagttccaaccggtacctaacaccattttcaaacgccaatgccaataacggctctcacctaatggcacttgatgagttatgacacaggcgactccaatgagcctttcaccatcgaaccagccaattaaaggttgttcttgttgccaaagttccgttaactcctcgcgaatagaggcacgtagtttctgctcgtaactagcttggttagtagtagcaagagcttcaataaagaaaggatcatcatggtaagcgttataaataattgatgcagccacgcgtaaatcttctgcagttaaataaacagctctgtgttcttctaacgtgttttgttccatgtttacactctttactaaaccaagttaatagttacaacttaacaagtttaaaacatattgcaattttaatgctgtcacctaggcttaaagatatctcgatagccaagtacacgataaattggggatgaaaatggatacaacttcagcaacacttgctcacttgtttgaacagctaggattggattcatcagatgctggaataagcgtttttctatcgcaacataccatcaaagcaagtacaaatttaactgaggctgacttttggaataatgctcaaagagcatttttagaagagagtttaaaagatgacgcccagtggtcagaactggtagaccaactggacgttttgttaaggcaatagccacaagcttttaataaggcaattgccaaaagcaaaggccactctttgaaacacattaaaaagtgacagtgcttaatagtttatttaaattttttgatacgcagtgtcaccccaacccactagcttattatcactaatgacaaccggcgtacactcatcttttgtggtcttgccgtcacctttactccattgagtacgataaaagagtacgtttacttcttttttcgggctttcggcgtctgcctgagtaacgtatgcctcactaaaatctgcagttcccattaatatagtgacttgatctctcgccatacccatagtgagttttgataaattggctctgttagtttgttgctgtgtttcccaataagaatcactatggttaccttcgctgccaccaacatgaaatacacaaccacttaatgtaaggctacttgcagccattaaaaatgctaaacccaattttgttttcatgatacttccttattattaaaatgattctcacgtaatttctactcaaactgcttttgagatacgttataatgttgtctattatcattaagctaaaaacatgccaaagtttatacttttgattttattgaatattatttaatgaacattaataagtaagtattttcactaatccatattgaggattttcaccaattatgagtccaatcgaacaagtcctcgctgcagcgaaaaccattgcattgaatggccatacaccgacgatggcattagttaaaggtaagctcggtggcaaagtgcccatgcctttgcttatccaagggttacaacaatttaaagctattccgaaagaccaatggcaaactctgcctgacttaggtgattcacttgaatcaaataagcctgcagccaacacagatacccaagccatagaacaaaagctactgactcaaatgcagcaaatgaaaaccgaatttgaaagcaaaatttcgttattagaacaacgtattgcccaacttgaaaacaaagcgtaaatacataaataactgtcgttagcgctgttaatcattggcacgattgactactagtacgattaaccactgcctaataacgctgacgcatcgcgcttataaccccaaagttaaacggaaccccatgtttgtcacagagctaagatttgaatgttttgcggataccacaatcaccgcagccgaaaaagccattaaccattacctcgaatctttgcgagccaacggccaagccttgggaagagaatttgccgtcgcatttaatgaaggtgagtttaaagttaggttattaatgccagaaaaaaccagtctatcgactcgtcataatagtccttggacgaaacaagcgttaaaccagctcaccgaagctaaattacttgcccctcgtgaaaagtttattggccaagatatcaactctgaagtcagtaattcagaaacacctagctggcaggtgctttatactagctacgttcatatgtgctcgcctataagaagtggcgataacttgttgcctattccgctttatcagatcccagccagctttaatggcgatcataaacgggttatccgctggcaaacagaatggcaagcttgtgatgaattacaaatggctgcagccacaaaagccgaatttgccgctttagaagagattacctcccataaaagtgacttattcagacgaggttgggacatacgcggtagagttgaattcatcactaagataccgacttactattatctataccgagtaggcggcgacagtttagctagtgaaaaagagcgtgcctgccctcgttgtggttctaaagaatggcgtttagatgaaccattactcgatatgttccatttcagatgtgagccttgccgcatagtatctaacatctcttgggatcatcaataagttgttatgaaatccaaataataaagccagacatttgtctggctttattataattaatcattcatcaactgattaaattaagacttcttacctttaatcaaatcagcccacatcattttcatgcgttgccaaatgcctgggtgcgcgacatagttatcttcaacaataggttcaacaggtggcatcacgcgcggggttaatccatcaataaactcagctaaactgtcagcgagtttatctttaggcttatcaccaggaatttcaatccacacactgccatcttcgttatcaacagtaatcatttgatcgccatcacctaatacgccaacaaaccaagtgggtgcttgtttgagctttttcttcataatcagatgaccaatcacattttgttgcaaagattcaaagtcttgctgattccaaacttgcaatagctcaccttctccccaagttgaatcaaaatataaaggcgcagaaaaatattcgccataaaacgcatttatatcttggtgcaacttaagctctaaagcatgttctacattactgaaatttgagctatttttacgtttaatcgctttccaaaaaaccgcatcatctgaatcaagatcatacttaccttcaatacaggcggatccttgcccaagtgggaaataacggggaaactcgcctaatacatcctgataagcttgaaaataacggctagaaaaatgatccaatgaagttgaacaagacacttaagatgctccaattttgggttataatataagtctattttgacacggaaacagactagatgacacacaatcacgatccctatagtgatgcagatgcacttaaaggactgactttaggtcaaacgacacaatatcaagcagaatatgatgcttcactgctacaaggggttcctcgtaaactcaatcgtgatgccatagcattaaccgattcgctcccttttcagggcgcagatatctggaccggctatgaattatcttggctaaatgccaaaggcaaaccaatggttgccattattgaagtttacctcgctatcgaaagtgataatttaatcgaatctaaatcgtttaaactgtatctcaacagctttaaccaaacacgttttgagtcagttgagcaggtacagcaaacattagtcactgacttaagccattgtgctaatggcgaagtgacagttaaagtgattgaacctaaacattttaatactcaacgtattgtcgaattaccaggtaattgtatcgacgaacttgatattgaagtggatgactacgagtttaatcctgactatctacaagacagtactgaagataaaaacgttgtcgaaacagtcacatctaacttattgaaatcaaactgtcttattacctctcagccagattggggtagtgtcatgatccgttatcaagggcctaaaattaatcatgagaagttgcttcgctacttgatttctttccgccaacataacgaattccatgagcagtgtgttgaacgtatatttactgacttaaaacgctactgtaactgcactaaactaacggtatatgcccgttatactcgacgtggcggtttagacattaatcctttcagaagtgattttgaacaaccacctgaaacccatcgtttagcaagacagtaatgggtttctaataataaaaagcctgcaattgcaggcttttatattgtttatagtcggcactaaaatttttacgcataatgcccaataatagccgctaaatcatctaccgtattggcaatatgatcaggtttaacatgccagctttctggctctgattggctataagctgctgcaacagaaatgaccttggcatcgctgcctaattctaattgcaaattacgggcaaattgtgcatccgcttcatgatccccgatgtacatcagtaagttactatttgcgtgacccagtattgattcaacacatttcaggccgccgaatgggtgtggtttttgattaccgttaggtacatcgtcatagccaataatcgctttaaacggtgcaccaatttcattgctattgagaacacggcgaatattattttgcgaattttgcgaacagatcccgtgatcaaaatgagaaaactgttcaacaacccccttaatgccgtcaaatagcatgacttctgtttcattcttttcttgaaactcagcccacatgcttccagcttgaagcatttcattttcagttaacccatagtaatcaacatagagttgctgccaatttttagcaccatgattagcttcatggtaattagcttcgcttagtaagtacttaggcaagttttcgccagttaaatgcggtgcaacgatagacagtattgctttggtgatatcaatatttttcggtacagaattgactagagttccatcataatcccaaagtattgcgtctaatttcattgcatcatctcattgtttaataaacggtattaaggagtacactgttggtgtaaaaagtggctcagatgaatctcgttaaatacctttaaattatgtaacgagaaatctggcgattaaaataagcttcatcgtgttaaaaaacaactgttatcacctcagtctgagctacctgttaagtttttactgctcgcgtcatcatcttaaaaaattggttaaaactgacttcatgagggttcagtgcatctcctgcaaatggaccatataataaggaaccgtataatatagcctcattgaggtttatagattaagagcaataacactactcatgccaaaaccaacctgtttaacggaattaaatcaagagtcgctcaatgactctcaagagcatcagcactttaaaatatttaaaccttatggatttttgagccagtttgttcctgaaacacgaaagaaaaagcacttacttgcagagctctcaaacttccccgaaaaaaccatggcgattggtcgcttagatcacgattccgaaggcttactcttgctcacaacagacggcatgatgagtcataaagtaagaagcaaaggcatagaaaaagagtattacgtgcaagtggatggcgatattaacgatgaggctgtatctctgttacaaaatggggttgaaattggcatcaatggcacaaaatatcttaccctgccttgtaaagcattcaagctaaacgcagagccaatgcttccctcacgcggtaaaaaaattcgcgatccaaggcatgggccaaccagttgggtatcgatcaccttatgtgaaggtaaaaatcgtcaaataagaaagatgacagcagcagtaggttttgcgaccttaaggctagtaagagtcagaattggcgatattcatattgatgccatgcaagcaggcgatgttatttctctgagcaattttgacgcggctattaatagcgataattaacggtcactttctagcaaatacaccttttccattgctgtttcaactaactcacgtaaccacttcgttgccgggtcttgttgattacgggtcggccaaatgctgtaaattgatatcaattggctttcgaacggtaaatccatcaaggttaaattaaaagtagattgatagtttttagcataggtatatggcgcaatgcagattgcatcagatttgctgactcccgataacatggtgagcaaagatgatttttcgccatacatatggcgttcaggtaaatgctctgtagaaataatctctgctactcgctgattatgtcgatgtaatcggtaaaacaaatgtttagccgtaaaatacgactgctcatcaataccatttttaaattgaggatggttcgccctcgcgacacaaacgagcttttcggtagcaatttgtttgctggaaaatgatgcttcgctcggcgccacaatatctaacgctaaatcaatatgctgtttttgaagcgcttgatataaattaccttcatcaataatcgcttcagtaaagatgatttcaacgcctttatcagccaccgatttttcaatatcggcctcaatcaaatcaataattgattcatttgcactgacatgaaaaacacgttttgattgctgcgggtcaaacactttaacgctattaatacactgctctatatcgattaaagatggtcctaaggtttggtgcaaatgttggcctattgcggtaagagcaatacctcgaccttgcctgacaaataactccgccccaacaagggttttaaagcggttaattgcattgctgacagaagattgggttagtgaaaggtgctctgctgcaagtgtaattgattgataatcacatacactacaaaataccctaacaagattaagatcgagcttatgcagctcttgttggctcctttcttgttgcagttgttctaattgcaattgccctaaaccttgcttcacttttaccaccttaatacgtcatttgaacaaatagatttccaatacaaatgctcattcaagtcattgattctcgcctaatacattcacacagtaaatgtattaactattcttagccatagttatctttgccaattttgttgttaacttatattcaacaacaataaatcctagaggcttacatgagaaaatcattacttggtttagcgattaccctaacgtttaccacccaagcttttgcagctcaacatgaacacgaccatatcactgttgattaccatggtaagcccgcaactcctatcactgctgaacataataagtcagtagcaaaaaccttaaactttgatgataaagccgcttttgagcgatttagcaaaaacaaaatcgcctcatttgatgaagctacagccaaaattctacgagcagaatttagctttattagtgaagagttaccggactctgtaaacccatcattatatcgtcaagcacagctgaatatggtgccaaacggactatataaagtcacaggtggtatctaccaagtccgtggtacagacttatctaacctaacccttatccgaggcaaaactggctggattgcttatgatgtattactcaccaaagaagcagcgcagcaatcgttaaagtttgcttttgctaacttaccagaaggtcaggatttacctgttgtcgcgatgatttactctcatagccatgccgaccactttggcggtgcccgtggagtgcaggaactatatcctgatgtgaaagtctatggttcaaacaatatcacctcagaaattgttgatgagaatgttcttgctggtaacgtgatgagccgccgcgcagcatatcaatatggcgccacactgggtaaacacgaccacggtattgtggatgcagcacttgccaaaggtttatcaaaaggtgaaatcacttacgttaaacccgactatgaacttaatcataaaggtaaatgggaaaccttaaccattgatggtcttgaaatggtatttatggatgcctctggcactgaagccgccagtgaaatgatcacctacattccgtcaatgaaagcgctatggtcaggtgaattaacttatgatggcatgcacaatgtatacaccttaagaggagctaaagtacgcgactctttaaaatggtctaaagacattaatgaaatgattaacgcctttggtgaagacgtaaacgtattatttgcctctcattcagcgccagtttggggcaataaagaggttaatcattaccttcgcatgcagcgtgataactatggtttagttcataaccagtcaatgcgtttagccaatgacggcatagttattcaagatattggcgacgctatcatggagaccatacctcaaaacgttcaagacgaatggtacaccaatggttatcacggcacctatagtcataatgccaaagctgtatacaacatgtacttaggctactttgacatgaatccagccaatttaaatccattaaccactaaagcagaagcaacaaaatttgttgaatatatgggcggtgcagataacgtggtgaaaaaatcaaaacatgattttagccaaggagagtatcgctttgttgccacagcacttaataaagtcgttatggcagatccacaacacgatgcagcccgagagttacttgcagacacctacgaacagctaggttatcaagctgaaggggctgggtggcgtaatatttatctcactggtgctcaagagttacgagtgggtattaagcctggcgcgccaaagtcggcctctgctgatgtgatcagcgaaatggacatgtcgaccttatttgatttcttagcagtaaaagtcgacagcattaaagctgcggcacttggtaacattaccttgaatgtagtgacacaagatggaagccaaaccaacaccttatttgttgagttaagtaacggtaacttaagcaatattgctgtcgagtctccaaaacaagctgatgcaactctgactgtaaataaagctgatgtggttggcatactattaggcaagacgaatatgaaagcgctgatgcaatcaggtgcggcgacaatggaaggtgacaaacaggctttcgctaaaatcgcttcgactctagtgcaatttaatcctgactttgaaatcgttccattaaagcatgctcattaattagggcttgttaaatgatgagagtctagtggctcagaataaacagttttaaaacgaaacagttttacctatcagttggtttgaaggcgtgatttacaacttcaagccaactgattttttttgctttcagctccggaggtaactcgtctgaatttgtagacgcacgacccacactcacagcaaaacgatacaaatcatcaagctttcctaaataacaatgccactgcggggcaatgacaaaatcctctaataaaccatcagagtcactcgcctttagtaagcttaacttgacattttgttggatggtgattgtctcactgttaacttgtagttcacccacacttgaggcagataaatcaaacgcaaaagattttagcgataaagctagacctaagcctttcgcttttatataagactccttaagcgcccataaatcaaaaaagcgttctctgtgtttatcttcagctaaagccagtaatgcactctcttctggttttgaaaaatagtgatttagaatcgaatgaatattcgttgtttcacgacggcgttcaatgtctacaccaagttctatatctgtttgttgttgagctgttccatatgtgtttgccaccccgattaacaaccagtcaccactgtgactcagattaaactgcaaaccagtttgcgcaaactgctccgccgttaacctcggcttgcccttctcaccatattcaaattgccattgctgcggctcaacactagcaaagcgcgataacacactgcgtaaatagcctcgcaccattaaaccttgttctctagatgattgctgaataaaacgatcaacctttttgacctcatcttcaggcagccatgaacgcacaatagacgcagtcgattcatctaataaatcagtattaaggggacagaaaaataattgaatgacggttggcggcttcaaactaggctcaggctaaattggcaatgtaccattgtcgcttgttttaggaagcgatttcaacaagcaaggttacttatcgatatggttgcggcgttaatacgctgatgtgtcaacgccaaaacgtgggttcactgaactaaaacagtcttgaactaactttaattaatccaaaacaaacttaatttacctgatgaaaaaaagggttgagcaatgctcaaccctctatgggttttatcctataacaggcatttaaaaattactctgccagtgcttttactgccttttgaggaagcacatcgtagcggctgaaatgcatcgagaattgcccttcgccacctgtcatcgacttaagccgagtggagtaattactcacgttagccagtggcgcttcaacactcacttccactaaaccattgctacttgcttgggtaccgcaaacgatacctcttgaagaactaatatcccccgtaatttcacccacatggttttgagccacatgaatttgcatatcaacgataggttctaaaataaccggctgagccagttttaccgcttccataaaggcttttttgcccgccataacaaaagcaatctcctttgaatcgacactgtgatgcttgccatcaagcaaagttaccttcacatcctgtaatgggtatccacccatttcgcccgctaacatggcttcgcgtacacctttctcaacggctggaatgtactgggttggcacagaaccgcccaccacttgggagacaaactcaaaaccttgtccacgcgctaacggttcaacttttaattcaacttcgccaaattggccagatccacctgattgctttttatgacgatatcgatactctgcctcagccataatggtttcacggtaagccacagccggcgtatcagtttccatatccacattaaataaattttgcgctttctctaaggcaatttgaaggtgtaagtcaccttgtccttgcagcacggtttgaccttcagcttcgttgcgactgatttgtaaacttggatcttcggccaccagcttatttaatacttccgatattttctgctcatcaccacggcgtttagctgatactgccagaccaaaaataggttgcgggaatttaagctcgggtaaatggaattcatcttcatcatgactatcgtgaagcacagctcccacagataactcttcaagcttagcaatggcgcaaatatcaccaggtaacgcttgattgacattaatttgtttgtcgccttgaagtttcattaagtgagacactttaaacggcttgcgtccgctaccaatgaacaatttcattcccacagaaatcgtaccttgatacaagcggaaaacccccatacgtccaaagaacggatctatcgccaccctaaatacatgcgctaaaacatgatcagaggctttttgagtgacatcaatcggcttagcttcatcaccgtagcctttaataaattgcggcggattcgcttcaagtggattcggcattaacttaaccagaatctctaacaacgaactgatgccaatatcttgctctgcgctagtaaaacaaactggcaccaagtgccccattcttaacgctgtttccaatggcgcatgcagttgctctggcgtaagtgattcgccttgttctaaataaagctccattaaagcttcatcttcttcaagtacggtatcaaccagctcatctcttgctgtagcggcattgctaaacaaagtattgaaagtttcatcacaatgtaagtagcagtcaaccacatcatcgaccaaaccatcagctgtaacattgggtaaattaaccggtaagcatctgtggccaaattgatgttgaatatccatcatcacatcaaacaccttggcttcatttccatccatgtgatttatcgcaatgatgactgctttaccttggcttcgagcagcttcaaatgctcgttttgtcacggattcaatgccaacacttgcgttcaccactaacaatacagattcaacaccaggtaatggtaatagcgcacgtccaaagaagtcgggtaatccaggagtatcgatgaaattgatgtggtgagattgataatcgagatttaaaaatgaaggttctaaactgtgacgatgagatttttcttgggcagtgaaatcagcatgatttgtacccttatcgaccctgccttttaaacttatagcatcagcgctaaagagtaacgcctcaagtaacgaggatttacctgcgcctgtgtgtccgagcactgccagattgcggatttgctcagtggtaaactcagccatgatggcctcctttgttcacattattaaactatccatatctttgtcttactatgtttacatttgacgataaaacacccataaattcagtatagatcggtaacattgttgaataattgacacagatcactctttacacccgcaacgttttttataacaaaatcacccattcagcttacaagtgttagctctttctggtcgtatcagtaattaattagtttcgggtgattgtatcgacctgaaacctcaggtactctgcatgctcgattgtgataaaacgctaataatgaagatgaacaaacgttaatcttcagtattttttagagagtcccaatagattgtacggagtgttcattctgctatggccgtccttaaatgactgcaaaccgacaagctaaatcagccactaaaacagtggtaaaaaaatcctcttccgattgtgatgtagcgagcacacctgtgcgccatcgtaatgcgacaacgacccccgaaatgcgtcaatttatccaaacttccgactttagtgtcagccagttggctaaaattctgaacatatcagaagccacggtaagaaaatggcgcaaacgtgactccatcagcgatacacccaatacgccacatcacttaaaaaccaccctttcacctatggaagagtatgtggttgttggcttacgttatcagctgaaaatgccgttagacagattgctaaaagtcactcaacagttcatcaataaagatgtttctcgttcaggacttgcccgctgcttaaaacgctacggtgtatcgaaactcgatgaattcgaaagcccctatgttccagaacgctatttcaaccaattaccgattgttcagggtacagatgtagcgacttacacactgaaccctgaaactcttgctaaaaccctgtcattgcctgaagccacaccagacaatgtggtgcaagtggtatccctaacgattccacctcaactgactcaagcagacagctattccattttactcggtgtcgactttgcaaccgactgggtgtatctcgacatttatcaagacaaccacacacaagcaaccaatcgctatatcgcttatgtgttaaagcacggaccgttccatttacgtaaattactcgtcaaaaattatcatacttttttagcccgttttcctggtgcaacagtgttgcactctgtggaagcggcgaaccaaaaaaataaatcagctaaggatcagctgaacactggagactcaaaatgagccaagcccctacaaatcctgagacctcatctcaagataacaacgagtcgcaagatacaagactgaacaaacgtcttaaagacatgcctattgccatcgtcggcatggcaagtatctttgctaattctcgttacctgaataagttttgggacttaatcagcgagaagattgatgccatcacagaagtgcctgatacccattggcgcgctgaagattactttgatgccgataaaagcaccccagataaaagctactgtaaacgtggtggatttatcccagaagttgatttcaacccaatggaattcggcctgccaccaaatattttagaactgactgatacttcgcaattgctatcattagtgattgccaaagaagtgcttgcagatgcgggcgttacctctgagtacgataccgacaaaatcggtattacgctgggtgtgggtggcggtcaaaagattaatgcaagcttaaccgcgcgcctacaatacccagtacttaaaaaagtatttaagagcagtggtctaagtgatgctgacagcgatatgctgatcaaaaagttccaagaccaatacattcactgggaagaaaattcattcccaggctcactaggtaatgttattgctggtcgtattgctaaccgcttcgatttgggcggcatgaactgtgtagtagatgctgcatgtgcgggctctcttgctgcaatgcgtatggcgttaactgagctagttgaaggccgcagtgaaatgatgatcacaggtggtgtgtgtaccgataactcaccatcaatgtatatgagtttctctaaaacgcctgcgttcaccaccaatgaaaccattcagccatttgatatcgactcaaaaggcatgatgattggtgaaggtatcggcatggtagcacttaagcgcctagaagatgctgagcgtgatggcgaccgtatttattctgtgattaaaggtgtcggcgcttcatcagacggtaaatttaagagtatttatgcaccgcgccctgaaggccaagcaaaagcattaaaacgagcttatgatgacgctggttttgcccctgaaacagttggcttaatcgaagctcacggtacgggtactgctgcaggtgatgtagccgaatttaacggccttaaatctgtatttggtgaaaacgatccaactaagcaacacatcgctttaggttcagtgaaatcacaagtgggtcacacgaaatcaaccgctggtactgctggcgtgattaaagctgcccttgccctgcaccataaagtattgccaccgaccattaacgtctctaagccaaaccctaagcttaatgttgaggattcaccgtttttcgttaataccgaaacacgcccatggatgcctcgccctgacggcactcctcgccgtgctggtattagctcgttcggttttggtggaactaacttccacttagtattagaagaatacacccctgagcacagccatgatgagaaataccgtcaacgccaagtggctcaaagcttattaatgagtgctgataataaagcagccttgattgcagaagtgaataagctaactgcagacatcagcgcgcttaaaggcacagataacagcagcattgaacaagctgaacttgctcgcattgctaaactatatgctgttcgcaccatagatacttcagcagcccgtttaggtcttgtggtatcaagccttaatgaattaaccactcagcttggtttagcgttaaagcagcttaataatgatgttgatgcatggcaactgccatcagggactagctaccgctcttcagcactcatcacgattaatgcaaaccaaaaggcgactaaaggtaaaaaagcgactaacgcaccgaaagttgcagcattgtttgcaggtcaaggctctcagtacgtcaacatgggtattgaagtcgcttgtcacttccctgaaatgcgtcagcaattaatcaaggccgataaagtattcgcaagctttgataaaaccccgctgtctcaggtgatgttcccgattccagcctttgaaaaagcagataaagatgcacaagcagctttactcaccagcactgataacgcgcaaagcgccattggtgtaatgagcatgagccaataccaattgtttactcagtctggtttcagtgcggatatgtttgcaggtcacagctttggtgaactgtcggctttatgtgctgctggcgttatctctaatgacgattactaccagttatcatttgctcgtggtgcagctatggcttcatcagcagttgataaagatggcaatgagctagataaaggcaccatgtacgccattatcttgccagccaatgaagctgatgctgcaaacagcgataacatcgccaagctagaaacctgtatctgtgagtttgatggcgtgaaagtcgctaactacaactctgcgactcaattagtgattgctggcccaacggactcttgtgcaaatgcagccaaagccattagtgctttaggctttaaagccattgcgcttcctgtatcaggtgccttccatactccacttgttgggcatgcgcaaaaaccttttgcaaaggcaattgataaagctaaatttactgccagcaaagttgatttattctctaatgcgacaggtgaaaagcatcctgctgatgctaaatcaattaaagcggcgttcaaacagcacatgttgcaatcagtgcgtttcactgaccaattaaacaatatgtatgatgctggtgcccgtgtatttgttgagttcggacctaagaatattttacaaaagctggttgaagcaacgctaggtaataaagctgaagctgtatctgtgattagcattaaccctaatcctaaaggcaatagcgatgtgcaattacgtgtcgctgctatgcaacttagcgtattaggcgctccgcttactgaagttgacccttaccaagctgaaatcgcagcccctgctgtaccaaaaggtatgaacgtcaagttaactgcgtcaaaccacatcagcgcaccaactcgtgccaagatggaaaaatcattagcaacaggccaagtcacttcacaaatcgttgaaacgattgtagagaaagttatcgaaatgccagttgaaaaagtagtagagaaaatcgtggaaaaagaagttatcaaaactgaatatgttgaagttgccgcatctggcgcaacagcagtgcctaacgccgctgcaccagtggctcaagcttctcaagtaatagcacctcaaatgcaagttcaggcaacgcctgtagctggcagcttagaagcgttctttaatgcacaacagcaagccgctgatttacatcagcaattcttagccattccacaacagtatggtgacacctttacacacctaatggccgagcaaagtaaaatggccgctgctggacatgctattcctgagagcctacaacgttcaatggagctattccaccaacatcaagctcaaacactacaaagtcatactttgttccttgagcagcaagcacaatcaagccaaaacgcattaagcatgctgactggccaagcaccagctacaacaacgccagctgttaatgctcctagagttaatgcgcctatcactgaaaatccagtagttgctgcgccagtcgttgaagctgttaaagtagccgctacggttcaaactccgacggcacaagctccagctgttcaagcgtcaattactcaaactgctgccaaaccagccgctatggccgctccagcgccacgtattgaaccagtaaaagcaactgccccagttgcagctcctgtcgttgcgccagcagttgcagcagcacctgcaggtttaagcgcagaaacagttctgaatactatgttagaagtggttgcagaaaaaacaggttacccaactgaaatgcttgaattaagcatggatatggaagctgatcttggtattgattctatcaaacgtgttgagatcttaggtactgttcaagacgaactgccaacactacctgaactaagccctgaagatttagccgagtgtcgtacgcttggtgaaatcgttgactacatgaactctaaacttcctaaaagtgacgcttcaggaactcaaacgcaagtcgcgccagttcaagcagcatcaggccttagcgctgaaacagttctgaataccatgcttgaagtggttgctgaaaagaccggttacccaactgaaatgcttgaattaagcatggatatggaggctgatcttggtattgattctatcaaacgtgttgagatcttaggtactgttcaagacgaactgccaacactgccagaactaagccctgaagatttagctgaatgtcgtactcttggcgaaatcgttgactacatgaacagcaagcttcctgctgctggctctactccagttgcatcaccagttcagtctgcggctccggtatctggccttagcgctgaaacagttctgaataccatgttagaagtggttgctgaaaagactggttacccaactgaaatgcttgaattaagcatggatatggaagccgatttaggtatcgattcaatcaagcgtgttgagattctaggaaccgttcaagatgaactgccaacactgccagagcttagccctgaagatttagctgagtgtcgtactcttggtgaaatcgttgactacatgaactctaagcttcctacaagttcagccgcaggcgctaatacacaggctgtagctccagttgctcaagaatcaggtttaagtgctgaaacagccttgagcgcgcaagaagttcaaagcactatgatgactgtagttgctgaaaaaaccggttacccaactgaaatgcttgaattaagcatggatatggaagccgatttaggcatcgattcaatcaagcgagttgaaattctaggtacagttcaagacgaattaccaacactacctgagctaagtcctgaagatctagctgaatgtcgtactcttggtgaaatcgtatcttatatgaattctaagttacccgccgcaggcgctatgaacagcacagccgttgtagctcaagcttctggtttaagtgctgaaacagccttgagcgcgcaagaagtacaaagcaccatgatgactgtggttgctgaaaaaaccggttacccaactgaaatgcttgagctaagcatggatatggaagcggatttaggcatcgattcaatcaaacgagttgagatcttaggtacagttcaagatgaactaccaacgctaccagagcttaaccctgaagatttagctgagtgtcgtacccttggcgaaatcgtgagctacatgaacagcaagcttcctgctgtcagtgcgacaactgccgcagggactcaaacacaagcagccgcaggcgctactcaagcttctggtttaagtgcagagcaagtgcaaagcactatgatgacagtcgttgctgaaaaaaccggttacccaactgaaatgcttgagctaagcatggatatggaagcagatttaggcatcgattcaatcaaacgtgttgaaattttagggacggttcaagacgagcttccaggcttacctgaattaaaccctgaagatttagcagagtgtcgcaccctaggtgaaatcgttagctatatgaacagcaaactttcaacaagtgcagctgaaggctctcagccaacgctaagctcaactgacacttcaccagcaacagccacagctgagttagcaacagacttacctcctcatcaggaagttgctctaaaaaagctaccagcggcggataagttagttgacgttttttcaaaagacgcatgtatcgttatcaatgatgacggccataacgcaggtgttttagctgaaaaattagtagcaacaggcctaaccgtcgccgttattcgtagccctgagtcagtgacatctgcgcaatcaccgcttagcagtgatattgccagcttcactttatctgcggtcaatgacgacgcgattagcgatgtcattgctcaaattagcaagcaacataagatcgccggctttgttcacctgcaacctcaactaacagcacaaggtgctttgccattaagtgatgcaggttttgtagcagtggagcaagctttcttgatggctaaacacctacagaaaccatttgctgagctagctaaaactgagcgcgtaagctttatgactgttagccgcattgatggcggatttggttacttaaacagtaacgaacttgcaaaggctgagctaaaccaagctgcattatctggtttaactaaaacattaggtcatgagtggccaactgtgttctgtagagcattggatattaccccaagctttgaggcagttgagttagcacaagccgttattgaagagttatttgatcttgatactgcaactgctgaagtgggtattagcgaccaaggtcgtcataccttatctgctaccactgcagctcaaacccgttaccaaaccacatcattaaacaatgaagatacagtgttggtgactggcggagcaaaaggcgtcacattcgaatgtgcccttacccttgcgaaacaaactcagtcacactttatcttagcgggtcgcagtgagcatttagccggtaatttaccgacttgggctcaaggcaaacaggctaaagaattgaaagctgctgcaattggatttattcaatctcaaggtaataagccaacaccaaagcaaattgatgccttagtttggccgattaccagcagtttagaaattgatcgctcattagcagcatttaaagctgtcggtgcaagtgctgaatacatcagcatggatgtcagctcagatgcagccatcaagcaatcacttgctggcctcaaaccgattacaggcatcattcatggtgcgggggtactcgccgataaacacattcaagacaaaacattagctgagttaggccgtgtatatggcactaaagtctcgggctttgccggcatcatcaatgcgattgatgcaagtaaattgaagctagttgctatgttctcatcagcagcgggtttctatggcaacactggtcaaagtgattactcaatgtcgaatgagatcctaaacaagacagcactacaacttgcagcgaactacccgcaagcaaaagtgatgagctttaactggggaccttgggacggcggtatggtcagttcagcgttaaagaaaatgtttgttgagcgcggcgtatacgttattccactcgataaaggcgcaaacttgtttgctcacagcctattgtctgaatctggcgtacagctattaattggttcaagtatgcagggctcaagctcagcagctaaaacaggcgcagctgtaaaaaagcttaatgcggactcttcgcttaatgccgagggttcgctgattctttcttttactgctccagataaccgtgttgttaacaacgcggttactgttgaacgagtactaaacccagttgcaatgcccttccttgaagatcattgcatcgcgggtaatccagtactgccaacagtgtgcgctatacaatggatgcgtgaaactgcgcaaaaactgtgtggcctacctgtgacggttcaagattataaattgctgaaaggcattattttcgagactaaagagccacaagtattaacgctgacattgacgcaaacagaatcaggcttaaaagcactgattgcgagtcgtatgcaaagtgatgccgttgatagcttgcttagacctcagtatcaagcaaacctgattgttaacgagaagattgttaacgagaaggttgctaaagaagcggtttcaaccacgctaccaactgcagcaaaaaatgcgcagcaattagcaagctcaggtaaagtcattagcactgatagcgagctatatagcaatggcagcttattccacggccctcgccttcaaggaataaagcagttgttaattgccaacgatgagcaattggtttgctcagttgagttgcctcaaattaccgctgtagattgcgcaagctttacaccgcaaacaggtttaggtggtagtcaggctttcgctgaagacttacttttacaagccatgttagtgtgggcgcgtatcaaacacgatgcagcgagcttaccgtcaaccattggtgaattaaccacatacgccccattcgcctcgggtgataaaggttacttagtgttaactgtgcttaaaagtactagccgttcattgactgctgatattgcgctttatcatcaagatggccgcttaagctgcactatgctaagcgcaaaaacgaccatcagcaaaagcttgaatgaggcctttttagccccagccaaagcattagctgatttgcaggagtctgtgtgagtaatcaactgcctccttcaacgtctgctattaaaagcatgcgaatagccttaaagatggttgcgaatgagcaagtctcattcgcaacatcttcaggcaatgattttagtgccaatagctttgcagcgattaagccttgctcattagctgaggccattggcgcttcagcaattgatcttgaaattgatgtatcaagcctagatgcgagtttgagtgaaaacgctgttaataaagcacttagctttaatgactattttgctcaagccatcatccatatcgagcaacaacatacggttttactcagtcaccctgaattaccgtatcgcttattaatgatgccagcgattgtggcggctaaacatcgttgccatcctcatgcctacttaaccggtttgggtgaagctgatgatatgccaagtgcaataaatgcggctttagttcaagccaagcgtgcacacattaaacctactcatgtcgatgcgactcaattaacttgttataaagataagtttgcccagttggttatgctgataggcagcattgccactcgcagtgtgccaaatacagtttcagaaaatcagtcagctgatgctcaatactggttcactgaaatgcaccaaaatcgcgttgccagctttaattttagtgaaggcaataagcaacacagtgcagtctttgtccaaggcactgagcttgctcaagcaagttctttggtagatgacaatcgactatttttgcctgtatcagccaatgaccttggaatgatgaaacagcagctgcaagcattaagcagtcaattggctgcgctgcctgcacaacatgacaagagtgacagttccgctatctccttcatgcttagccagctaaagcaatttgatcagacccagcctttatcggcagttgttatggcaaattcagtgactaatgcagtaagtgaaatcaatgtcatgcttagcacgattggtaaagctgaagccactgcggcaaatgaagttcaagctaaaagcaacttaagcattgaacacaaaaccccgtcaggaagctgctttcatctcacttcagataaagtacttggcaataatggcctgtgttttgtttaccctggcgtgggcacggtatacccgcaaatgtttgctcaactgccgcgctactttccagcattatttgcccagctagagcgcgatggtgatgtcaaagccatgctgcaagcggatagtatttatgctgaaaatgctaaaaccactgacatgagcttaggtgaactagctattgcaggtgtaggcgcaagttacatcctaaccaaagtgctcactgagcatttcggcattaagcctaactttgccatgggttactcaatgggcgaggcatcaatgtgggccagtcttgatgtgtggaaaacaccccacaatatgattgaagcaacgcaaactaacagtatttttaccactgacatttcgggccgcttagactgcgttcgtcaagcatggcagctagaacatggcgaagacattgtttggaatagctttgtggttcgtgcagcgcctgctgatatcgaaaaagtattagctgatttcccacgtgcataccttgctatcatccaaggtgatacttgtgtgcttgcaggctgtgaggaaagctgtaaagcgctacttaaacaaattggtaaacgtggcatagcagcgaatcgagtaaccgcaatgcacactaaacctgcgatgcttattcgagacaacgtacaagccttttatcagcagcctttgcatgagcaagatgttattgcacctttcgcaagccaaattaaatttatcagcgctgcaagccaatcgccgattaatttaaccagtgaagcgattgcaacatccattgctgataccttttgtcagccgttagattttacacaattagtcaataatgcacgtcatttaggcgcctcgctttttgtcgaaatcggcgctgacagacaaacgacaacactgattgacaaaatctcgcgtacctctgaaatggcgcaaacatgccaagccatttcagtgaatgcaaaaggcgatgaccaaactgcgctacttaaatgtattgctcaactgattactcataaaaccccaatttcgctcgattatcttactgagaccttgtcgagtttactgacgacaacattggcggcagaaaaacgaagtaatcaccacacaggcaatatgttggcccctcaattagaaggagaacaatcttgagttctcaatcaactaatctaaatacaacagtcccaaagattgccattgtaggtttagcgactcaatatcccgatgcggatacgcccgctaaattctggcaaaacttattagacaaaaaagactctcgaagcacgattaacagccaaaagctcaatgcaaacccagctgactatcaaggtgtgcaaggtgagtctgaccgtttttattgtgataaaggcggctacattcaaaacttcagttttgatgctaatggctatcgtattcctgccgagcaatttagcggccttgatgacagttttttatgggcaaccgatacagcacgtaaagcattgaatgatgctggtgttgatattacaaacccacaaaacaatggcgcattaaaccgcaccggtattgtcatgggaacactatcgtttccaacggctaaatccaatgaactgttcgtaccgatttatcacagcgcagtagaaaaagcgttgcaagataaactgcaacaaccaagtttcacattgcagccatttgatagtgaaggatatagtcagcaaacaacgtcagcttctttgtctaatggcgccattgctcacaatgcatctaaactagtcgccgatgcgctaggcttaggtgcagcgcaattaagccttgatgctgcttgtgcaagttctgtttactcattaaagcttgcctgtgattatttgcatactggcaaagctgacatgatgttagctggcgcagtttctggcgctgacccattctttattaacatgggtttctccattttccacgcctaccctgaccacggtatttcagcgccatttgatagtaattcaaaaggtttgtttgctggtgaaggtgctggtgttttagtccttaaacgccttgaagatgctgagcgcgatggcgaccatatttatgcactcgttagcggtatcggtttatcaaatgacggcaaaggccaatttgtattaagcccaaacagcgacggccaagttaaagcattcgaacgtgcttatgctgatgctgctatgcatgatgaaaactttggcccaaacaacatagaagtgcttgagtgtcacgcaacaggtacgccattaggtgacaaagttgagctgacgtcaatggagcgcttttttagcgacaaactcaatggcagtaacacgccgttaattggttcagctaagtctaacttaggccacttgctgactgctgcaggtatgccagggatcatgaaaatgatttttgcgatgcgccaaggtgttctgccgccaagtattaatattagcgcaccgattgcttcaccatcagaaatgtttggccctgcaaccttacctaatgatgttctcccttggcctgataaagctggcaatacagcccgccatgcgggtgtgtcagtatttggttttggcggttgtaatgcccatttattagttgagtcatactttgcgaagagtcatggccagccttctagcacagagttagttaaaccagcgacaacgaccatcaatgcgcaaatgccaatgcacattaccggtatggcatcacactttggttcgttgtcgaacgtaaatgactttgctgatgcggtaaataacaatcaaaccgcatttacctcattgccagctaaacgctggaaaggtttagataaacacccagagttattacaaaaattcggactgagtcaagctgcgccaacaggtgcttatattgatcaatttgatttcgacttcttacgctttaaagtgccacccaatgaagatgaccgtttaatctcgcagcaattgttattaatgaaagtagcagatgaagccattcatgatgccaaacttgagtcaggtagcaaagtggcggttttggttgcaatggaaacagaacttgaattacatcagttccgtggccgcgttaacttacatacccaaatagctgccagcttaacagcccatggcgtgagcttatctgatagcgaataccaagcattagaaaccattgcgatggacagcgtgttagatgccgccaagcttaaccaatacaccagctttattggtaatattatggcgtcacgcatctcatcattatgggattttaatggccctgcctttacgatttcagcaggcgagcaatcagttaaccgctgtattgatgtggcgcaaaacctactggcgatggagtctcgtcaagagcctctagatgcagcgattattgccgcagtggatttatctggcagtattgaaaatatcgtgcttaaaacggcgaacattaataaaacaggctcaactgaagcactcaatattggtgaaggggctggcgcaattgtattgcaagcagccgctattgatagcgagcactgcgacctaatacatcaaggtttaggcgcgttagatacgctagattcagcaagcacccacagttatggcaccatcgacagtttggcatttggtcatacagaccagctttcaaccattagcgatgacgtgttaactcctgttggattggctgcaactgatattgatttattagagttaaaccaagcacctgatttgctcaatattgataatgcgcaaatgctatcgcagctatttaaccaatcgagcaccagcaaagcgcaatcttgtatcgggcacacttttgccgcttccggtattgccagcttattgcatggcttattgaaaactcgattgaatgcttctgtgcagaacgctaactcggatagcaaactgagcaataagcccaaccaaaaggccataatcgctactttgagcgaaaaccagtgttcgcagcttcttatcagccaaaacgctgaacaagcaagcgcgatgagcactcgtattgacactgatatacaagcgcaaacggccaagaaattgagcctagttaagcaagtcagtttaggtggtcgtgacatctaccagcatattgttgatgcgccactggctaacattgacagtattagagcgaaagttgccaagcttaaccctgttgcacctacaactgtgatgaacttacatgaccgcggccaatttatcgcgccagctcatgccaattcagcgcctatgtccgctaacaataattcaatgactacagagacttctatgccgttttctgatcgttcaacccagtttaaccctacacctaaagtggctacgcctactgcactttccactcaggcagctcaggcaactcagtcagctcaaacgtcttcagtgacgagctctgtcgcagcaattagccaagtgccacctacgcatttaagcgcttttgagcaaaaccaatggttagcacatcaagcgcaattagcatttttaaagagccgcgaacaaggcttaaaagtcgctgatgcacttttaaagcaagagattgcacaagcaaatggtcagccttatgttgcccaatcgacggcacaagctgtagcgcccgtccaagcggcaaacgtgttagcgcagccaatagcatctgcgtcaatcttgcgtccagatcatgcaaatgtgccaccctacacagcgcctatcccagcgaataagccatgtatttggaactacgctgatttagtagaatatgccgaaggtgatattgccaaagtatttggcccagattacgccgtgattgataactactctcgccgcgtacgccttcctacaactgattacttattggtatctcgcgttactaaactcgatgcaacaatgaaccaatataagccttgtagcatgaccacagagtatgacatcccagaagatgcaccttacttagtcgatggccaaatcccttgggcggtagccgttgaatcaggccagtgtgatttaatgctgatcagttatttaggcattgattttgaaaacaaaggtgagcgtgtttaccgtttacttgattgtacgctgaccttcttaggcgacttacctcgtggcggcgacacattgcgttacgacattaaaatcaataacttcgctaagaatggcgagacactattattcttcttctcctacgaatgtttcgtcggcgataagatggtcttaaaaatggatggcggctgtgctggcttctttaccgaccaagagttagatgacggtaaaggggttatttacaccgaagatgaaatcaaaacccgtgaagcggcgttaaatacgccaaacaaaccgcgttttgaaccgctattacattgtgctcagactcaatttgactatggtcaaatccatcatttactcaatgctgatattggcagctgttttgctggcgaacaccataaccaccagcaagcatcaggtaagcaagactcattatgttttgcctctgaaaagttcttgatgattgagcaagtgggcaatttagaagtccatggcggcgcttggggcttaggctttatcgaaggccataaacaattagcacctgatcattggtacttcccttgtcatttccaaggcgaccaagtaatggctggctcattaatggctgaaggttgtggccaattattgcagttcttcatgctgcacattggtatgcacaccttagttgaaaacggacgtttccagcctttagaaaatgcttcacaaaaagtacgttgtcgtggccaagtactgccacaacatggtgaactgacgtaccgcatggaagtcacagaaattggtactcaccctcgcccatacgccaaagccaatattgaaatattgctcaatggtaaagcggtcgtggacttccaaaatcttggggtgatgattaaagaagaaggtgaatgtactcgttacactgccgactctactgaaacacatacaacctcaggcacagtccaaaaaaacaacagccacaacacaccagcatcattaaatgcaccgttaatggcacaagtgccagacttaagtgaaccagccaataaaggcgttatcccgctgcaacatgttgaagcgcctatgctgccagactacccaaatcgaacccctgatacgctgccgttcaccgcgtaccatatgtttgagtttgcaacaggtgacatcgaaaactgttttggacctgactttagtatttaccggggctttattccgccgcgcacgccatgtggtgacttacagctaacaacccgtgttgttgatattcaaggtaaacgtggcgagcttaaaaaaccgtcatcgtgtatcgctgaatatgaagtgccaaccgatgcgtggtattttgctaaaaacagtcacgcttcagtgatgccttactcggtattaatggaaatatcactgcaaccaaacggatttatttcgggttacatgggcacaacccttggtttcccagggcaagagctattcttccgtaaccttgatggtagcggtgagttattgtgtgatgtagatttacgcggcaaaaccattgtcaatgattctaagctattatctaccgttattgccggcagtaacatcatccaaagtttcagctttgatttaagtgttgatggcgagcctttctatactggtagcgctgtatttggttactttaaaggtgatgcacttaaaaaccagctaggtattgataatggccgtattactcagccatggcatgttgaaaataacgtagcggctgatatcaccgttgatttgcttgataagcagtcccgcgtattccatgcaccagcaaaccagccacattatcgtttagctggcggtcaacttaactttatcgacaaagctgaaatcgttgataaaggcggtaaaaatggtttaggttacttgtctgcctcacgcaccattgacccaagtgattggttcttccagttccacttccatcaagatcctgtgatgccaggttcattaggcgttgaagcaattatcgagttaatgcaaacttacgccatcagtaaagacctaggtaaaggtttcactaacccgaaatttggtcagattttgtctgacatcaaatggaagtaccgtggccaaatcaacccactaaataagcaaatgtcgctggatgtgcacatcagtgcagtcaaagatgaaaacggcaaacgtatcattgtgggtgacgcaaacctcagcaaagacggtttacgtatttacgaagtaaaagacatcgctatctgtatcgaagaggcataaaggaataataatgactattagcactcaaaacgaaaagctttctccatggccttggcaagtagccccaagtgatgccagctttgagaatgccgctatcggtaaaaaattaaaagaactgtctcaggcgtgttatttaattaaccaccctgaaaaaggcttaggtatttcgcaaaacgcacaagtaatgactgaaagcatgaacagccagcaagacttaccagttagtgcatttgcacctgctttaggcactcaaagcttaggcgacagtaatttccgccgcgttcacggagtaaaatacgcctactacgctggcgcgatggccaatggtatttcatctgaagagttagtgattgcattaggccaagctggtattttgtgttcatttggcgcagcaggattaattccatctcgcgtagaacaagccattaatcgcattcaaacggcgctacccaatggcccgtacatgtttaacttaatccacagcccaagtgagccagcattagaacgtggcagtgttgagttatttttaaaacataaagtgcgcacggttgaagcatcagcatttttagggttaaccccgcaaattgtctattaccgcgctgcaggtttaagccgtgatgctcaaggtgaagtggttatagccaacaaggttatcgctaaagtaagccgcacagaagtagcgagtaagttcatgcaacctgcacctgctaaaatgctgcaaaagctggttgatgaaggcttaatcacacctgagcaaatggagctcgcacaattagtcccaatggcagatgatgtgacagcagaggctgattctggtggtcataccgataaccgtccattagtgacgctattgccaacaattttggcgcttaaagataaaattcaagccgagtaccaatacaagacgcctattcgtgtcggttgcggcggcggcgtgggaacacctgatgcagcattagcgacctttaacatgggcgcagcgtatatcgttaccggctcaatcaaccaagcgtgtgttgaagctggtgccagtgaacatactcgtaaattattagcgacaacagaaatggccgatgtcaccatggcacctgctgctgatatgtttgaaatgggcgttaaactacaagtggttaagcgcggtacactattcccaatgcgtgccaacaagctttatgagatttacactcgttatgaatcaattgaagcgattccagctgaagaacgtgaaaaactagagaaacaagttttccgttcaacccttgatgatatttgggcaggcactgtggctcactttaacgaacgcgaccctaagcaaatcgaacgcgcagaaggaaaccctaagcgtaaaatggcactgattttccgttggtacttaggtttatcaagccgctggtcaaattcgggcgaagtcggccgtgaaatggattaccaaatttgggcaggtcctgcacttggtgcgttcaatgaatgggcaaaaggcagctatttagatgattatacccagcgaaatgcggtagacttggccaaacacttgatgcatggcgcagcttatcaagcccgcgttaacttattaactgctcaaggcgtggcactgccggttgaattgcaacgctggagcccgctagatcaggttaagtaacggacgttgtagctttataacgtcagcagtgatactcgccatattgcgatcaagttaaccattactattgtgccactcactcaacatgagtggcacattgatatttagtttgcagttaggtaacagtatgagcgaaacccaaaagttagatttttcagcggtaaatggcacaacactagcctcgtttaatcagcataaaaacttgatcaaacgtatgctaaaaggcaacagcgctgaatgtagcgagtgtaaaaaaccactcactttgcaattaccgcctaacattaagaacgctaaaccaagtgataaagcaccaggcatatattgcgcaaaaggctgtaccgatatcgagctagatatggaagcagtggcattaatgaagtagccgaagataagaacacagttctttaggtataagcctttataagcacaattacgaagcaccttatgggtgcttttacttttcctatcccaccaaagatattgttttaactaacttaagaagggttagtatgtggcataactaactcagctaaccattcataatatttttcattcccatgaatccaatccacttgtccatttgaataagttattgggctgataaattcatgaaagtcataaccttcttcgataaaaatacgagcagcattgacaaacgttatatcaaattgtgctagtacgtaatctatcgcctcaaaatatgcaaaaataatatttgccataggtttagcttcttcaacaaatttactaaaaggaggatctgaaacaacaattactttatggccaatacttttcaatttgatcaaaatagataattgatcctgaatgtcatcatgaaagtaatctacaaattccttagtctcaatattactaatcccttgtggatattgacgtttcacccagtctacaaatctagctgcactttgatgtgtctgtagacccacattacatataactgtagattgactaaccgttttattattttcatgtatagataagttatttaatacatctttccaaagtgttctagacgctgcactttctaaaggcacgaatatctcagtatcacatatagcaaacttcttttgcgcgaaccctgatccattcattatcattcctcctgtatgaggaatattccttaatttcattgcattagaaagttttcccatatgactatcaccaaatatggaaatggaatccccgtcattcgatagttgtttagagttcaactttctagaagcttgtaaaaactcttcatcgcaaactacttcatcacttactgttttatcaactttatcggtaattgaaatatctttacttaatgtttcaccaaaatgcttcatgacataactgaccatctctgctgtaacagttcttagattttccttaaatctatagtctgtagaaatgggtaatgtaactaattcataagaaggaaaataactaaatactgcctcatattcacttagttcacctgcaacagctcgtaatgtcgacttagagtattggttagcgattgctatatgatttgacgtagctgtagctgttaatggtacgggtgagacagtgagtacaatctgaatgttaggatttatacattctacaactttagctatttctttaagatcattttgaatttcagcgaatgtaaaattatgaaaattataatttttttgtttatattctccttggataaccccgggacaactaggatagcaaaccccatttatatcaaaccatgcttctgttaatcccaatgtaaaaattaacacatcagtcttcgcaattgtttgcttcatttcatcaacggcagcttttcttgcctgaattaaagcactctcggatgagtaacctaactcgttatataaaggtcttagcaaatcatagaatcttgtttcattgtgataaattgagtgatctgtcttgaagctctgattatcacaattaagccactgtaaaaaacaccttggcgtataaacatttccaaaagcaaaactagatacattagcttcgtctaattcactttgattaaaattaaaattattgtcatttagccacttaccgacatgctgagcaaaacatgaaccaactgacgatattctgggcacattagttttgaaatttatatcaaccaaattagatattgtttcttcaaaatagttttgagaaacaacgccagttttccaaaagtgctgggaagctttatgtgtataaggtgtcaatttaaactccaaaaatgatatggttaagctcatagtcaaattagtgactttcattaaagtaagcattatatatgccatttaaatactaactataaaactgaaattcgacttgccactcacccaccaaatagccttgctaaatctattcctctcgtcataaagtctcatttttaccaacaaaaataatgcgttaacatttttttgacctgtatcaataataagtcttattagctaaggcactatgcctcattatttttaatgtggttatattttttatgagtcaaatcaaggctaacaacaatattgagcaagcgctaactgacaattgcattcttttgtcgaccacagatctgaatggcaacataaaatacgccaataaagcatttgccgatatttcagaatacagcactgaagagctacatggacagcctcataatattgttcgtcaccctgatatgcctaaagctgcatttaaagcactttgggatcgtgtaaaagatggcaaaccatggtgtggcatcgttaaaaataaaaccaaatctggcaaatattactgggtgaatgcgtatatttcgccagtttttgaaaatggccgtttacatgaacttcaatcaatcagacgtaaaccatgtcaggcacatatcaaatcagctgaaagcatctaccaacaacttaatgaaggtaaagaacctgctgcgatatcaccaccactctttagcttcacgggtgcactctgcctatgggcagtgtttatctcgttaattggcgttatttcttcgttattaatgcctacgctagttgcagcattttttatcccgttactggcaggttttggtatttactttctaacaagaccccttaaagaacttgaaactaaagccaccaatattattgatgatc

SEQ ID NO: 76 - protein, 2768 aa, Sh. olleyana
MSQAPTNPETSSQDNNESQDTRLNKRLKDMPIAIVGMASIFANSRYLNKFWDLISEKIDAITEVPDTHWRAEDYFDADKSTPDKSYCKRGGFIPEVDFNPMEFGLPPNILELTDTSQLLSLVIAKEVLADAGVTSEYDTDKIGITLGVGGGQKINASLTARLQYPVLKKVFKSSGLSDADSDMLIKKFQDQYIHWEENSFPGSLGNVIAGRIANRFDLGGMNCVVDAACAGSLAAMRMALTELVEGRSEMMITGGVCTDNSPSMYMSFSKTPAFTTNETIQPFDIDSKGMMIGEGIGMVALKRLEDAERDGDRIYSVIKGVGASSDGKFKSIYAPRPEGQAKALKRAYDDAGFAPETVGLIEAHGTGTAAGDVAEFNGLKSVFGENDPTKQHIALGSVKSQVGHTKSTAGTAGVIKAALALHHKVLPPTINVSKPNPKLNVEDSPFFVNTETRPWMPRPDGTPRRAGISSFGFGGTNFHLVLEEYTPEHSHDEKYRQRQVAQSLLMSADNKAALIAEVNKLTADISALKGTDNSSIEQAELARIAKLYAVRTIDTSAARLGLVVSSLNELTTQLGLALKQLNNDVDAWQLPSGTSYRSSALITINANQKATKGKKATNAPKVAALFAGQGSQYVNMGIEVACHFPEMRQQLIKADKVFASFDKTPLSQVMFPIPAFEKADKDAQAALLTSTDNAQSAIGVMSMSQYQLFTQSGFSADMFAGHSFGELSALCAAGVISNDDYYQLSFARGAAMASSAVDKDGNELDKGTMYAIILPANEADAANSDNIAKLETCICEFDGVKVANYNSATQLVIAGPTDSCANAAKAISALGFKAIALPVSGAFHTPLVGHAQKPFAKAIDKAKFTASKVDLFSNATGEKHPADAKSIKAAFKQHMLQSVRFTDQLNNMYDAGARVFVEFGPKNILQKLVEATLGNKAEAVSVISINPNPKGNSDVQLRVAAMQLSVLGAPLTEVDPYQAEIAAPAVPKGMNVKLTASNHISAPTRAKMEKSLATGQVTSQIVETIVEKVIEMPVEKVVEKIVEKEVIKTEYVEVAASGATAVPNAAAPVAQASQVIAPQMQVQATPVAGSLEAFFNAQQQAADLHQQFLAIPQQYGDTFTHLMAEQSKMAAAGHAIPESLQRSMELFHQHQAQTLQSHTLFLEQQAQSSQNALSMLTGQAPATTTPAVNAPRVNAPITENPVVAAPVVEAVKVAATVQTPTAQAPAVQASITQTAAKPAAMAAPAPRIEPVKATAPVAAPVVAPAVAAAPAGLSAETVLNTMLEVVAEKTGYPTEMLELSMDMEADLGIDSIKRVEILGTVQDELPTLPELSPEDLAECRTLGEIVDYMNSKLPKSDASGTQTQVAPVQAASGLSAETVLNTMLEVVAEKTGYPTEMLELSMDMEADLGIDSIKRVEILGTVQDELPTLPELSPEDLAECRTLGEIVDYMNSKLPAAGSTPVASPVQSAAPVSGLSAETVLNTMLEVVAEKTGYPTEMLELSMDMEADLGIDSIKRVEILGTVQDELPTLPELSPEDLAECRTLGEIVDYMNSKLPTSSAAGANTQAVAPVAQESGLSAETALSAQEVQSTMMTVVAEKTGYPTEMLELSMDMEADLGIDSIKRVEILGTVQDELPTLPELSPEDLAECRTLGEIVSYMNSKLPAAGAMNSTAVVAQASGLSAETALSAQEVQSTMMTVVAEKTGYPTEMLELSMDMEADLGIDSIKRVEILGTVQDELPTLPELNPEDLAECRTLGEIVSYMNSKLPAVSATTAAGTQTQAAAGATQASGLSAEQVQSTMMTVVAEKTGYPTEMLELSMDMEADLGIDSIKRVEILGTVQDELPGLPELNPEDLAECRTLGEIVSYMNSKLSTSAAEGSQPTLSSTDTSPATATAELATDLPPHQEVALKKLPAADKLVDVFSKDACIVINDDGHNAGVLAEKLVATGLTVAVIRSPESVTSAQSPLSSDIASFTLSAVNDDAISDVIAQISKQHKIAGFVHLQPQLTAQGALPLSDAGFVAVEQAFLMAKHLQKPFAELAKTERVSFMTVSRIDGGFGYLNSNELAKAELNQAALSGLTKTLGHEWPTVFCRALDITPSFEAVELAQAVIEELFDLDTATAEVGISDQGRHTLSATTAAQTRYQTTSLNNEDTVLVTGGAKGVTFECALTLAKQTQSHFILAGRSEHLAGNLPTWAQGKQAKELKAAAIGFIQSQGNKPTPKQIDALVWPITSSLEIDRSLAAFKAVGASAEYISMDVSSDAAIKQSLAGLKPITGIIHGAGVLADKHIQDKTLAELGRVYGTKVSGFAGIINAIDASKLKLVAMFSSAAGFYGNTGQSDYSMSNEILNKTALQLAANYPQAKVMSFNWGPWDGGMVSSALKKMFVERGVYVIPLDKGANLFAHSLLSESGVQLLIGSSMQGSSSAAKTGAAVKKLNADSSLNAEGSLILSFTAPDNRVVNNAVTVERVLNPVAMPFLEDHCIAGNPVLPTVCAIQWMRETAQKLCGLPVTVQDYKLLKGIIFETKEPQVLTLTLTQTESGLKALIASRMQSDAVDSLLRPQYQANLIVNEKIVNEKVAKEAVSTTLPTAAKNAQQLASSGKVISTDSELYSNGSLFHGPRLQGIKQLLIANDEQLVCSVELPQITAVDCASFTPQTGLGGSQAFAEDLLLQAMLVWARIKHDAASLPSTIGELTTYAPFASGDKGYLVLTVLKSTSRSLTADIALYHQDGRLSCTMLSAKTTISKSLNEAFLAPAKALADLQESV

SEQ ID NO: 77 - protein, 743 aa, Sh. olleyana
VSNQLPPSTSAIKSMRIALKMVANEQVSFATSSGNDFSANSFAAIKPCSLAEAIGASAIDLEIDVSSLDASLSENAVNKALSFNDYFAQAIIHIEQQHTVLLSHPELPYRLLMMPAIVAAKHRCHPHAYLTGLGEADDMPSAINAALVQAKRAHIKPTHVDATQLTCYKDKFAQLVMLIGSIATRSVPNTVSENQSADAQYWFTEMHQNRVASFNFSEGNKQHSAVFVQGTELAQASSLVDDNRLFLPVSANDLGMMKQQLQALSSQLAALPAQHDKSDSSAISFMLSQLKQFDQTQPLSAVVMANSVTNAVSEINVMLSTIGKAEATAANEVQAKSNLSIEHKTPSGSCFHLTSDKVLGNNGLCFVYPGVGTVYPQMFAQLPRYFPALFAQLERDGDVKAMLQADSIYAENAKTTDMSLGELAIAGVGASYILTKVLTEHFGIKPNFAMGYSMGEASMWASLDVWKTPHNMIEATQTNSIFTTDISGRLDCVRQAWQLEHGEDIVWNSFVVRAAPADIEKVLADFPRAYLAIIQGDTCVLAGCEESCKALLKQIGKRGIAANRVTAMHTKPAMLIRDNVQAFYQQPLHEQDVIAPFASQIKFISAASQSPINLTSEAIATSIADTFCQPLDFTQLVNNARHLGASLFVEIGADRQTTTLIDKISRTSEMAQTCQAISVNAKGDDQTALLKCIAQLITHKTPISLDYLTETLSSLLTTTLAAEKRSNHHTGNMLAPQLEGEQS

SEQ ID NO: 78 - protein, 2020 aa, Sh. olleyana
LSSQSTNLNTTVPKIAIVGLATQYPDADTPAKFWQNLLDKKDSRSTINSQKLNANPADYQGVQGESDRFYCDKGGYIQNFSFDANGYRIPAEQFSGLDDSFLWATDTARKALNDAGVDITNPQNNGALNRTGIVMGTLSFPTAKSNELFVPIYHSAVEKALQDKLQQPSFTLQPFDSEGYSQQTTSASLSNGAIAHNASKLVADALGLGAAQLSLDAACASSVYSLKLACDYLHTGKADMMLAGAVSGADPFFINMGFSIFHAYPDHGISAPFDSNSKGLFAGEGAGVLVLKRLEDAERDGDHIYALVSGIGLSNDGKGQFVLSPNSDGQVKAFERAYADAAMHDENFGPNNIEVLECHATGTPLGDKVELTSMERFFSDKLNGSNTPLIGSAKSNLGHLLTAAGMPGIMKMIFAMRQGVLPPSINISAPIASPSEMFGPATLPNDVLPWPDKAGNTARHAGVSVFGFGGCNAHLLVESYFAKSHGQPSSTELVKPATTTINAQMPMHITGMASHFGSLSNVNDFADAVNNNQTAFTSLPAKRWKGLDKHPELLQKFGLSQAAPTGAYIDQFDFDFLRFKVPPNEDDRLISQQLLLMKVADEAIHDAKLESGSKVAVLVAMETELELHQFRGRVNLHTQIAASLTAHGVSLSDSEYQALETIAMDSVLDAAKLNQYTSFIGNIMASRISSLWDFNGPAFTISAGEQSVNRCIDVAQNLLAMESRQEPLDAAIIAAVDLSGSIENIVLKTANINKTGSTEALNIGEGAGAIVLQAAAIDSEHCDLIHQGLGALDTLDSASTHSYGTIDSLAFGHTDQLSTISDDVLTPVGLAATDIDLLELNQAPDLLNIDNAQMLSQLFNQSSTSKAQSCIGHTFAASGIASLLHGLLKTRLNASVQNANSDSKLSNKPNQKAIIATLSENQCSQLLISQNAEQASAMSTRIDTDIQAQTAKKLSLVKQVSLGGRDIYQHIVDAPLANIDSIRAKVAKLNPVAPTTVMNLHDRGQFIAPAHANSAPMSANNNSMTTETSMPFSDRSTQFNPTPKVATPTALSTQAAQATQSAQTSSVTSSVAAISQVPPTHLSAFEQNQWLAHQAQLAFLKSREQGLKVADALLKQEIAQANGQPYVAQSTAQAVAPVQAANVLAQPIASASILRPDHANVPPYTAPIPANKPCIWNYADLVEYAEGDIAKVFGPDYAVIDNYSRRVRLPTTDYLLVSRVTKLDATMNQYKPCSMTTEYDIPEDAPYLVDGQIPWAVAVESGQCDLMLISYLGIDFENKGERVYRLLDCTLTFLGDLPRGGDTLRYDIKINNFAKNGETLLFFFSYECFVGDKMVLKMDGGCAGFFTDQELDDGKGVIYTEDEIKTREAALNTPNKPRFEPLLHCAQTQFDYGQIHHLLNADIGSCFAGEHHNHQQASGKQDSLCFASEKFLMIEQVGNLEVHGGAWGLGFIEGHKQLAPDHWYFPCHFQGDQVMAGSLMAEGCGQLLQFFMLHIGMHTLVENGRFQPLENASQKVRCRGQVLPQHGELTYRMEVTEIGTHPRPYAKANIEILLNGKAVVDFQNLGVMIKEEGECTRYTADSTETHTTSGTVQKNNSHNTPASLNAPLMAQVPDLSEPANKGVIPLQHVEAPMLPDYPNRTPDTLPFTAYHMFEFATGDIENCFGPDFSIYRGFIPPRTPCGDLQLTTRVVDIQGKRGELKKPSSCIAEYEVPTDAWYFAKNSHASVMPYSVLMEISLQPNGFISGYMGTTLGFPGQELFFRNLDGSGELLCDVDLRGKTIVNDSKLLSTVIAGSNIIQSFSFDLSVDGEPFYTGSAVFGYFKGDALKNQLGIDNGRITQPWHVENNVAADITVDLLDKQSRVFHAPANQPHYRLAGGQLNFIDKAEIVDKGGKNGLGYLSASRTIDPSDWFFQFHFHQDPVMPGSLGVEAIIELMQTYAISKDLGKGFTNPKFGQILSDIKWKYRGQINPLNKQMSLDVHISAVKDENGKRIIVGDANLSKDGLRIYEVKDIAICIEEA

SEQ ID NO: 79 - protein, 542 aa, Sh. olleyana
MTISTQNEKLSPWPWQVAPSDASFENAAIGKKLKELSQACYLINHPEKGLGISQNAQVMTESMNSQQDLPVSAFAPALGTQSLGDSNFRRVHGVKYAYYAGAMANGISSEELVIALGQAGILCSFGAAGLIPSRVEQAINRIQTALPNGPYMFNLIHSPSEPALERGSVELFLKHKVRTVEASAFLGLTPQIVYYRAAGLSRDAQGEVVIANKVIAKVSRTEVASKFMQPAPAKMLQKLVDEGLITPEQMELAQLVPMADDVTAEADSGGHTDNRPLVTLLPTILALKDKIQAEYQYKTPIRVGCGGGVGTPDAALATFNMGAAYIVTGSINQACVEAGASEHTRKLLATTEMADVTMAPAADMFEMGVKLQVVKRGTLFPMRANKLYEIYTRYESIEAIPAEEREKLEKQVFRSTLDDIWAGTVAHFNERDPKQIERAEGNPKRKMALIFRWYLGLSSRWSNSGEVGREMDYQIWAGPALGAFNEWAKGSYLDDYTQRNAVDLAKHLMHGAAYQARVNLLTAQGVALPVELQRWSPLDQVK

SEQ ID NO: 80 - protein, 290 aa, Sh. olleyana
LKPPTVIQLFFCPLNTDLLDESTASIVRSWLPEDEVKKVDRFIQQSSREQGLMVRGYLRSVLSRFASVEPQQWQFEYGEKGKPRLTAEQFAQTGLQFNLSHSGDWLLIGVANTYGTAQQQTDIELGVDIERRRETTNIHSILNHYFSKPEESALLALAEDKHRERFFDLWALKESYIKAKGLGLALSLKSFAFDLSASSVGELQVNSETITIQQNVKLSLLKASDSDGLLEDFVIAPQWHCYLGKLDDLYRFAVSVGRASTNSDELPPELKAKKISWLEVVNHAFKPTDR

SEQ ID NO: 81 - protein, 35 aa, Brassica napus
MLKLSCNVTNHLHTFSFFSDSSLFIPVNRRTLAVS

SEQ ID NO: 82 - DNA, 2004 bp, Schizochytrium sp.
atggctaccggcggcaagatgagcatcgaggtgcccggatcggcacggcccgacctgggctttggcgcgatccggagatcgatcatcgagaccggcccgcagaccacgttgaacggacatcgtagcctctacgaggtctttcgcctggctgcagagacgcacggctcgcgaaagtgtcttggacgcagggtcacgctcccgaacggccagctcggcggcttcgacgagtggaccacatacggagaagctctcgaccgcgcgcacaactttggcgccggtcttaccaaccttgggctgtgcacgcccaacaccgacggtctccagctccttggctttttcggcaagaaccgtcccgaatgggttattggcgacattggctgctactcgcagggaattgtccccgtgcccatgtacgacacgctcggcgcagatagcgtcgagtacgtggtgcgccagacggagctcaagaccatgttttgcacgatggaagagctcgagcgcgtctgcgaggtcgcgcaaaaggatctccttggcgcagccattctcatggacggcgaatttttcgacgaggctgacgtgatgcgcgcacgccagcaggccgaggcaagtggtctcaagctctacacggtacgcgaggtcgaggccgtcggcaaggagaacccggcgcccttggtccttccgcggggcgaagacgtggccttcttttgctacacgagtggcaccacgggcgaccccaagggcgccctcatccggcattcgggtctcctgagctgcatggcctcctttcgcgatgtgggcctcatcatgacccatgaggatgtctacctttcgtacctcccgctcccgcatgtctttgagcgcggatgcctgtacacggcgctgagtggcggtgccgcggtcggcttttacggcggtgacacgcagctcatcgtcgaggacctcgtggctctgcgccccacgctcttcccctcggtaccgcgtctctacaaccgcatctacgacaagcttcgcgccggcgttgatgaggccggcggcgtcaagaagtggctctttgagaaggctctcgctgccaaaaaggagggtttgcgcgctgggcgttacacgcacccggtatgggatcgtcttgtcttcaactcggtcaaggccaaggtcggtctcgaccgtgcgcgcatcatgtgcacgggctctgctccgatctcaagccacgttctcgagttcctccgtgccgtctttggctgccccgtcctcgagggctatgggcagaccgagtcctcgcttctcatttcggtgccccttatgaacgatactacactcaaccacgtcggcattccggccccctgctgcgagattcgtctcgaggatgtcgctgacatgggctaccgcgccactgacaagaagcataatggcgaggcttgcgagggtcgcggcgaaatctgctttcgtgggcccaacaactttaaggagtactaccgcatgccggaaaagacggccgagaccattgacgaggacggctgggtgcacacgggagacattggtctctggaccccagagggtcgactccgtatcattgaccgcaagaagaacatcttcaagcttgcgcagggcgagtacgttgctgctgagaagatcgagaacattatgcttcgctcgccgctcgccgcccaaatctttgtctacggcgactctcttcagagctgccttgtggccattgttgttccggatgcggatgcgcttcaaacgcgcggcatggctgtcgacgatccggccaccaagcaggccatttttgacagtgtggtcaaggaggcgcgcgacgccgcgctcaatggctacgagatccccaagcgcattcacattagcccgcaggagctgaacatgttgcctgagcgcaacggcctcaccacgctgcttacgccgacctttaagcttgtgcgcaacaaggccaaggactactttgctccggagatcgacgccatgtacgccgacatcaactccacttccaagctc

SEQ ID NO: 83 - protein, 668 aa, Schizochytrium sp.
MATGGKMSIEVPGSARPDLGFGAIRRSIIETGPQTTLNGHRSLYEVFRLAAETHGSRKCLGRRVTLPNGQLGGFDEWTTYGEALDRAHNFGAGLTNLGLCTPNTDGLQLLGFFGKNRPEWVIGDIGCYSQGIVPVPMYDTLGADSVEYVVRQTELKTMFCTMEELERVCEVAQKDLLGAAILMDGEFFDEADVMRARQQAEASGLKLYTVREVEAVGKENPAPLVLPRGEDVAFFCYTSGTTGDPKGALIRHSGLLSCMASFRDVGLIMTHEDVYLSYLPLPHVFERGCLYTALSGGAAVGFYGGDTQLIVEDLVALRPTLFPSVPRLYNRIYDKLRAGVDEAGGVKKWLFEKALAAKKEGLRAGRYTHPVWDRLVFNSVKAKVGLDRARIMCTGSAPISSHVLEFLRAVFGCPVLEGYGQTESSLLISVPLMNDTTLNHVGIPAPCCEIRLEDVADMGYRATDKKHNGEACEGRGEICFRGPNNFKEYYRMPEKTAETIDEDGWVHTGDIGLWTPEGRLRIIDRKKNIFKLAQGEYVAAEKIENIMLRSPLAAQIFVYGDSLQSCLVAIVVPDADALQTRGMAVDDPATKQAIFDSVVKEARDAALNGYEIPKRIHISPQELNMLPERNGLTTLLTPTFKLVRNKAKDYFAPEIDAMYADINSTSKL

SEQ ID NO: 84 - DNA, 2343 bp, Schizochytrium sp.
atgcccactcccgacgccaccgcgcctctgaacaagccgagcgactatgccgtctaccacgaggaagacggccccttctggaccgccgattccagcggcgtctcgcgcgtgaactttagcgagaccggcgtgggatccgagggcgtcatccctgcgctcacgctcatcgacgtcttcgagagggccgtcaagcgcggcggaaacaggatcgccttccgcacggaaaacatgcccacgctccgccgcggcgaagaggccccggacgcgctgccgctcaaggactggaagtcctggtcctggaaacagtacaaggccgacgtccaccgcatcgccagggctctcatggacctcggcgttgagcagcatgacgccgtctccatttttggctttaactcgcccgaatggtttctcagtgccgtcggcgccgtgcacgcaggtgccaagattgccggcatttacccctcagacacgcccgcccaggtccagtacaaggccttccacagtgacaccgctgttgccgttgtcgaaaacgagcagtgcttcaagaagttcgccgaggtcgtcgaggaccttccttacctcaaggccattgtttgctgggactatgaagccacagacatcacgcgcgaggacggctccgtcgtcgaggtcctcacctttgccgagttcctcaagcgcggcgacaccgtcgaggcggccgcccttgacgagcgcatctccaagatcgagcccaccatgtgcgctgcccttatttacaccagcggtactaccggccgccccaaggccgttatgatttcgcacgacaaccttgttttcgaggccagcgccgtcgtccccaacctcggaggagcctgtacgaccactgctgaggagcgcattctctcgtacctgcctctctcgcacgtcgctggtatgatggttgatattattgcccccatcattgccaccgccttccacaagggccgcatctgcgtctgctttgctcgcccgtacgatttgcgcaccggcacgctgggccagcgcctcaacgccgtggagcccaccatcttccttggcgtgccccgtgtgtgggaaaagattcaggaaaagctcatggccgtcggtgccaaaaccaccggcctcaagaagaagctctctacggccgccaagaagcgtggtcttgaattccaggaggagcagcaaatcggccgctccggtgccaaccctggctttggcccccttggcatctacaagaagctcctcggcctcatcaagggcaagctgggcctcaccaagtgcaagtttgcctttgctggtgccgcgcccatgacccgtgagacccttcagtactttggcgcgctgaacatcaacattaacgaggtctacggcatgtccgagtgctccggtgccgccacctggtccacggacaaggcccacgagtggggcactgttggctacgagatgcccagttgcgaggtccgcgtcttcaagattgccgaggacggtaccaagaccgagtgcccgcgcgccgccgacattatgcatgctaccgaggaggagcagggcgaagtttgcttccgcggccgtaacatcatgatgggctaccttgccaaccccaagcttggcgacgaccacgttgccgagatcgaggagaagaacgctgccgctatcgactccgagggctggctccacagtggtgataagggcgccatttctacccgcggcatgctcaagatcacgggccgctacaaggagctcatcatcggcgccggtggcgagaacgtggcgcccgtccctattgaggacgccatcaaggcgcgcatgccttttgtttccaacgccatgatggtcggagataagcgcaagttcatggctgtcctccttaccctcaagacggttggcgccacgggcgagcttcccggtacgaacaagctcatgggcgctgccgccgactatggtgagaccatcgaggacgcctgcgacaacgaggcgctcattgaggagatcacgcagcagctcaaggagatcggtgatgatggcgatgtcacgccctcgaacgcggctcgcatccaaaagttcaccattctcccgctcgacttttccgtctccacggacgagctcacggccacgctcaagctcaagcgctccgtggtcgcagacaagtacgaagacatcatcgaggccttttacgagtccaagagcgtttttgtgccgtactcgaccgttggcgcctacgccacgggcggcccggtcgacgactccgttgtcgatggctccttcaagggcgactttagcatgattggcgacgatgatccggatcttcaaaacgtcgatgtcctcgaggcgattgacgaggacaattaa

SEQ ID NO: 85 - protein, 780 aa, Schizochytrium sp.
MPTPDATAPLNKPSDYAVYHEEDGPFWTADSSGVSRVNFSETGVGSEGVIPALTLIDVFERAVKRGGNRIAFRTENMPTLRRGEEAPDALPLKDWKSWSWKQYKADVHRIARALMDLGVEQHDAVSIFGFNSPEWFLSAVGAVHAGAKIAGIYPSDTPAQVQYKAFHSDTAVAVVENEQCFKKFAEVVEDLPYLKAIVCWDYEATDITREDGSVVEVLTFAEFLKRGDTVEAAALDERISKIEPTMCAALIYTSGTTGRPKAVMISHDNLVFEASAVVPNLGGACTTTAEERILSYLPLSHVAGMMVDIIAPIIATAFHKGRICVCFARPYDLRTGTLGQRLNAVEPTIFLGVPRVWEKIQEKLMAVGAKTTGLKKKLSTAAKKRGLEFQEEQQIGRSGANPGFGPLGIYKKLLGLIKGKLGLTKCKFAFAGAAPMTRETLQYFGALNININEVYGMSECSGAATWSTDKAHEWGTVGYEMPSCEVRVFKIAEDGTKTECPRAADIMHATEEEQGEVCFRGRNIMMGYLANPKLGDDHVAEIEEKNAAAIDSEGWLHSGDKGAISTRGMLKITGRYKELIIGAGGENVAPVPIEDAIKARMPFVSNAMMVGDKRKFMAVLLTLKTVGATGELPGTNKLMGAAADYGETIEDACDNEALIEEITQQLKEIGDDGDVTPSNAARIQKFTILPLDFSVSTDELTATLKLKRSVVADKYEDIIEAFYESKSVFVPYSTVGAYATGGPVDDSVVDGSFKGDFSMIGDDDPDLQNVDVLEAIDEDN

SEQ ID NO: 86 - DNA, 2529 bp, Schizochytrium sp.
atggggtgctcggggtcgaagcccgcggcgccgggcgaggtcccggccgtgcaggggtacgaggtgacggaggaggtcgcgcccgggccgtatgacccggagaaggggccgtactatgtgagcaacaaggcggagcgcagggagatcatcttcgcggccaagggcgtcgcgagcgaagcaacgacgcccgccatgacgctctcgaaaatgttccgcaaggccgccgaggcctccaaggacgaagtcgcgctcgccgtcgagtggcccgtgcccgagatcggcgccgacggcaagatccccgactccctgcccctcgacaagtggcgcacctggacctttggccagtactacgcagactctcacgccatggcgcgcgccatcgtcgccctcggcgccgagcgcttcgacggcgtgaccatcttcggcttcaactctcccttttggctcatggcccaaatggccgcaacgctctccacgaccctccccgccggcatctaccccacggacaccgccgagcaggttcgctacaagctccgctacacggacactgccgtggccttttgcggcgtggaaaaggagttcaccatgctccgcgccgccgtcgaggacgccccggacctcaaggccatcgtctgctgggcccacctgcccatggtcaagaccatcacgcgcgaggacggttccaaggtcaaggtcatgtcctggcaggaggccctcgcgctcggtgaaatcacgccccccgccgaggtcgacgcccggatcgaggcccagaacccgggcgactgtgccgagctcgtctttaccagtggcaccaccgggcttcccaaggccgtcatgctcagccatgacaacctctgcttcgcgatcaccagcatcgtcagcaccctcgaggactttggccgctctggcccggagagccacctctcgtatctcccgctctcccatatcgcgggccaggagatggacgttctccttcccctcgtcgtgaccgcctttcgcgagagtcaccacgccgtctactttgtgcgtccctacgatctcaagaccggaacgctcattgaccgtgtcaagacggtgcagccgaccgcttttctgggcgttccccgcgtctacgaaaagatcatggccaagatgcgcgccaagggagcctccgtcaagggcctcaagaagaagatcgttcagtacagcaaaaagaagggcctcgaataccagcgcaacctcgaggtcggcggctccggcggtaagccctccaactacggctttgccgagaagaaggtcctgagcaaggtcaaggaggccctcggtttcacccgtctcaagtttgccatctctggcgccgcgcccatgtctcgcgaggtccaagagtactttgctggcatcggcattgcgatccttgacgtctacggcgccagcgagagcacgggaggcgtcaccggcaactccatcaaggcccaccaattcggtacggtcggccacactctgcccggcatggacgttcgggtcttccaaaaggccgagggcggcgacagtagtgccgagacgggtctcggcgagctccgtgagccggcgcgggccaaggacatcttccatccctccgaggaggagcagggcgaagtctgcttccgcggacgctccgtcatgctcggctacatggccaatcccaagcttggcgaggaacacgtcgccgaggtcgagcgcaaaaacgcatcggccatcgatcgccacggatggtaccattccggtgacaagggcgcctgttccaagaagaacatgtttgtcatcaccggtcgctacaaggagatcattattggcgccggtggcgaaaacattgcgcccctgcccatggaagatgccgtcaagtcccttgcccccggcgttgcgaacgcaatcatgatcggcgacaagcgcaagttcaatattatgctcatcacgcttcgcgccgagggcgccactggcgagttcccgggctcggacaacctcgaccccgatgtgcggagcattggctccgattccacgcgcacgattcaaaaggcaatggccgactccaagtggatcgagcatgtccgtgacgccatctccaagaccaacgccaatggcgacgcctgccagagcaacgcctggaagattggcagattcaccattctcccttacgacatctccatcgttggtggcgagctcacgccgacgctcaagctcaagcgcaactttgtcgacgaaaagtacaaggctgtcattgaccatgtctatgcgcacgagggcgacagcaaggatctcacatacgtcccttgccccatcgaccgggtgccgcgcaagatctctggcgacgagagcgctgctggagctgcgagcccggaggccaatgtcgccgagcctgtcacggccgagagcggttcaccttcggaggtaacgactgaggccaagcctgccaacgaaaccgacgacgccgagagcaaggacgccgctgcgccccttgcggccaaggtcgacacgacagttcctgacgtggcgcagcctcaggccgccagctag

SEQ ID NO: 87 - protein, 842 aa, Schizochytrium sp.
MGCSGSKPAAPGEVPAVQGYEVTEEVAPGPYDPEKGPYYVSNKAERREIIFAAKGVASEATTPAMTLSKMFRKAAEASKDEVALAVEWPVPEIGADGKIPDSLPLDKWRTWTFGQYYADSHAMARAIVALGAERFDGVTIFGFNSPFWLMAQMAATLSTTLPAGIYPTDTAEQVRYKLRYTDTAVAFCGVEKEFTMLRAAVEDAPDLKAIVCWAHLPMVKTITREDGSKVKVMSWQEALALGEITPPAEVDARIEAQNPGDCAELVFTSGTTGLPKAVMLSHDNLCFAITSIVSTLEDFGRSGPESHLSYLPLSHIAGQEMDVLLPLVVTAFRESHHAVYFVRPYDLKTGTLIDRVKTVQPTAFLGVPRVYEKIMAKMRAKGASVKGLKKKIVQYSKKKGLEYQRNLEVGGSGGKPSNYGFAEKKVLSKVKEALGFTRLKFAISGAAPMSREVQEYFAGIGIAILDVYGASESTGGVTGNSIKAHQFGTVGHTLPGMDVRVFQKAEGGDSSAETGLGELREPARAKDIFHPSEEEQGEVCFRGRSVMLGYMANPKLGEEHVAEVERKNASAIDRHGWYHSGDKGACSKKNMFVITGRYKEIIIGAGGENIAPLPMEDAVKSLAPGVANAIMIGDKRKFNIMLITLRAEGATGEFPGSDNLDPDVRSIGSDSTRTIQKAMADSKWIEHVRDAISKTNANGDACQSNAWKIGRFTILPYDISIVGGELTPTLKLKRNFVDEKYKAVIDHVYAHEGDSKDLTYVPCPIDRVPRKISGDESAAGAASPEANVAEPVTAESGSPSEVTTEAKPANETDDAESKDAAAPLAAKVDTTVPDVAQPQAAS

SEQ ID NO: 88 - DNA, 2040 bp, Schizochytrium sp.
atgcaggccctgctgggcctcgtcatgaaccaggaactcgaaggtggatccatgaagggctgcatggccgtgcccgtgggcaacgacacctaccgcaacgctcgcgtcaaggacgagctctttacccagccagacccgtctattcagaccatgggcgacatctggcgcgatacctgcgaaaaacacgcccagaacaactgcatgggctggcgtgacatcctcagcatgaccaaggacggcaacaaggaaaagtacgtccttggcggctacaactggatcacctaccgccaggctcagcgccgcgcgcgcaactttggcgctggtctcgctgcccttggtgtgaaaaagggcgaaatggtcaacttctttgccgatacaaaggccgagtggcagctcggctgccagggctgccttgagcgcggcatcgtcgtggccaccagctacgccaatcttggtcccgaggccgtcgcctacggcctcaagcagaccaagtgctcggttgtctttaccgacgctgaccttatcccgacgctcaacaaggttctcggcgactgccccgacgtcaagcacgtcgtcttctcgcgcgacaagcgcccggcgaaccatccggcccacaactccgacgagaaggtgcgcgacatgatcacgcacagcggcatccaggcgcacagctttgaagaggttgagcagctcggcgagggcgccaccaaggaggaccttccttcggttaagcccgatgacaccggtgtcatcatgtacacctcgggctccaccggcaaccccaagggcgtcatcatctcccaccgcaaccttgttgccggcattgccggttgcgccgatgccatttgcggcatgagcaccgacgatgtctaccttgcctacctcccgctcgcgcacattctcgagctcatcgccgagagctccctctactttcgcggtgtcgccgtcggctacggctccaccaagaccatcaccgacgcatccgtgtgtatcgaggccggcaagtgcgtcggtgacgccaacgagctccgccccacgctcatggctgccgtgcccatgattatggacaagatccgggccggtgtcatgaacaagatcaactccactggcggtatcaccaagcagctcttcgagcttggctttagccgcaaaaaggctgcccttgccgaaggcaaagaatctcccttctggaacaagatcctctttgacaacattcgcgcgcgcctccttggcggccgcgtccgctacatgctcagtggtggcggcccgctctccaaggacacgcaggacttcatgaacgttgtcttttgctgccccgtcggccagggatggggtctcactgagtccgtcggcgtcgccaccatttgctggcccaacgaccgcaccgctggccgtgtgggtgcccccatttgctccatgcaaatcaagctcgaagactgggaagagggcggctactacgctgaccctgctcgggctccggaggacaacaagcacccgcacccgcgcggcgagctccttcttggcgggccccagatcaccatgggctactttgaggagccggaaaagaccgaagaggcctactttaccgacgaaaacggcacgcgctggcttcgcacgggcgacatcggcgaggtctacccagatggcgcctttgccatcatcgaccgcaaaaaggatcttgtcaagctttctggcggcgaatacgtttcctttggcaagctcgagcccatgatccgcgactcggaccatgttgataacgctatggtctactgtgattctgaaaagtcctattcggttgccgtcattcaagtggcgtccgaatccaaggacgtcgatgacgagcgcattcacaaggacatcacttccatcctcaagcgtgcgggctgcgcaaagttcgagatcccccaaaacatctacgtcgagcgcgacctcgtctggggccctgataatgacctttgcacggctgctctcaagctcaaacgccgcaaccttgtcaaacattacgacaaggagctcaaggagctctacaatgagagctag

SEQ ID NO: 89 - protein, 679 aa, Schizochytrium sp.
MQALLGLVMNQELEGGSMKGCMAVPVGNDTYRNARVKDELFTQPDPSIQTMGDIWRDTCEKHAQNNCMGWRDILSMTKDGNKEKYVLGGYNWITYRQAQRRARNFGAGLAALGVKKGEMVNFFADTKAEWQLGCQGCLERGIVVATSYANLGPEAVAYGLKQTKCSVVFTDADLIPTLNKVLGDCPDVKHVVFSRDKRPANHPAHNSDEKVRDMITHSGIQAHSFEEVEQLGEGATKEDLPSVKPDDTGVIMYTSGSTGNPKGVIISHRNLVAGIAGCADAICGMSTDDVYLAYLPLAHILELIAESSLYFRGVAVGYGSTKTITDASVCIEAGKCVGDANELRPTLMAAVPMIMDKIRAGVMNKINSTGGITKQLFELGFSRKKAALAEGKESPFWNKILFDNIRARLLGGRVRYMLSGGGPLSKDTQDFMNVVFCCPVGQGWGLTESVGVATICWPNDRTAGRVGAPICSMQIKLEDWEEGGYYADPARAPEDNKHPHPRGELLLGGPQITMGYFEEPEKTEEAYFTDENGTRWLRTGDIGEVYPDGAFAIIDRKKDLVKLSGGEYVSFGKLEPMIRDSDHVDNAMVYCDSEKSYSVAVIQVASESKDVDDERIHKDITSILKRAGCAKFEIPQNIYVERDLVWGPDNDLCTAALKLKRRNLVKHYDKELKELYNES

SEQ ID NO: 90 - DNA, 1737 bp, Schizochytrium sp.
atgctggagatgcgcgaggaggtggtcaagcacgagggcgaggcggcgcacttcaagggcgtcaagatgaaggtgttcccgaacgggttccagaccatggtggatatcttcaaggtgccctttgagaagcaggtcatgaagaacgacttgctcgtcgacgagaccggacgcatgacctttcaggaggtctttgacaccgccgccgcgctcggcgacgccctcgtcaacgagtacggcgtggaaaagggcgatcgcgtcgtcgctctctccaagaaccgcaacgagtacattgtcaccatgatcgcggcgacctcggtcggcgccatctttgcacccctcaactcgtactggaagacggagcagctctcgtacggtctcgatgattcgggcgccaaggtcgtcgtctgcgacgccgaccgctacgtgcagctcgagcctctcctggacggccgcgcctccgcactggagcgcgttcttctcctccgtggccccggcactgaaaagttccgccccaacgccaagaccaccgcctttgacgaggtcattagcaagcacgccggcgccagaatgccgccctttccctgccaaaaggatgaccctgccatgatcatgtacacctcgggaaccaccggcaaccccaagggcgtcgtgctcacgcaccgcagcattggcgaagccatgacgggcgccgttgcagccatgacgtacgagaagacgcttgccgccaccagagctggcgagaccttgcccgagccggaagacccgtcgctgtcggccttcttgctcgccgtccctctcttccacgtgacgggccaccactgcgtcggtctgctctctatcattagctgccgcaagatcgtgctcatgagcaagtgggatcccaagcttgccctggagctcattgagagcgagcgcattacaaactttactggcgtgcccaccatggctctcgacctgatgacccacccggactttaagaagcgggacacgagcacgctcaagtctctcggcggcggtggcgcagcgcctccgagcaccatggtgaacgacattgacaagaactttaaacaagcgtctccgctgcaggcctggggcatgactgagaccaatggcatcgccaccctcaccgaaggcgacatgtaccggcgcaagccggaaagctgcggcaaggccatccccaatgtcgagattgccatctggaatgctcgcgatgagcccgtgcccgccggcgccgagggagagcttgtcattcgtgggtccacctgcctcaaagagtactggaacaagcccgaggctacggccaagagcatcacggccgagggctggttccgaaccggtgacattggcgtcattgacgaggaaggctttctccagctcaagggtcgtagcaaagagatcatcattcgcggaggcgagaatatttcctgcgtcgttgtcgaaaacgcagtctacaatcacgatgatatcaatgaagtggcggctatcccagtcccccatcccacgcttggcgaggaggtcggcattgccgtctttagccagtctggcgcgcgaccctcgctccagagcattcgcgatgtctgcgggaacctcgcgcgctatgaaatgcctacgcatatttattattggcccgagcagctcccgcgtggagacacgggcaagattcataagcgcaccattttggccgacatcaaggccggcaaggtcaaggacgaggctgtgcctgcctccaagctctga

SEQ ID NO: 91 - protein, 578 aa, Schizochytrium sp.
MLEMREEVVKHEGEAAHFKGVKMKVFPNGFQTMVDIFKVPFEKQVMKNDLLVDETGRMTFQEVFDTAAALGDALVNEYGVEKGDRVVALSKNRNEYIVTMIAATSVGAIFAPLNSYWKTEQLSYGLDDSGAKVVVCDADRYVQLEPLLDGRASALERVLLLRGPGTEKFRPNAKTTAFDEVISKHAGARMPPFPCQKDDPAMIMYTSGTTGNPKGVVLTHRSIGEAMTGAVAAMTYEKTLAATRAGETLPEPEDPSLSAFLLAVPLFHVTGHHCVGLLSIISCRKIVLMSKWDPKLALELIESERITNFTGVPTMALDLMTHPDFKKRDTSTLKSLGGGGAAPPSTMVNDIDKNFKQASPLQAWGMTETNGIATLTEGDMYRRKPESCGKAIPNVEIAIWNARDEPVPAGAEGELVIRGSTCLKEYWNKPEATAKSITAEGWFRTGDIGVIDEEGFLQLKGRSKEIIIRGGENISCVVVENAVYNHDDINEVAAIPVPHPTLGEEVGIAVFSQSGARPSLQSIRDVCGNLARYEMPTHIYYWPEQLPRGDTGKIHKRTILADIKAGKVKDEAVPASKL

SEQ ID NO: 92 - DNA, 1809 bp, Schizochytrium sp.
atgccggcgctgaccaaggagcaggaagcggcgatcgacgcggcgctgcacgcgcccgggacgctgctggagctgcgcgaggaggtcatcgcgtacgaggagaaccatgccccgcatcacaagggcgtcaagtaccaggtgtacccgaacggcccccagacgcttgtagacctcttcagcttccccaaggcgaccggaaacctcgacaacccgttcctcatctacgaggacaaacgatacacctttcgcgaggccgacgaggaggcctccgccctcggatccgcgctcattaacgattttggcgtcaagactctcgatcgcgtctgcatcgtctccaaaaaccgacccgagtacgccatcggcgtcatggcgtccacctcggtcggagccacctgcgtgcccatgaactcgtggtggaagaccaaggagctcgagtacggcctcgacaactcgggcaccaagatcgtgctttgcgatctcgaccgctacaagctcctcgtccccattctcgacaagctcaccaacctcgaaaaggtcatcctcttcgacgacgccaacgccggaagcgtcgagccccaccccaagctcctcatgtacaaggacgtcgtgtctaagcgccgcggcgacgccatgccgcctcttactgccggcaaggacgacaatgccctcatcatgtacacctcgggcacgacgggccatcccaagggtgtcgtgctcacccaccgcagcatctgccacgccatcacttgcgccgtggcgcacagtatccgccaaaagatgatggctgccgccaaggccgggaaaaccttcacgccggaggaggtcgaccctaaacactttgccgtcctgctcaacgtacctcttttccacgccacgggcctccactcggtcttcttcctctccttcgtcattggccgcaagatggtcatgatggacaagtggaacatcgagcaggccctccagctcatcgagcgcgagcgcgttaccaattttaccggtgtgcccaccatggtcctcgacatgatgaaccatcctaactttaaaaagtacgacaccagctctctcgaggctgttggcggtggtggtgctgcccccccctcgactatggtcaaggacgtgcagagcaacttcaagagcgctgcccctctgcagggttttggcatgaccgagaccaacgccctcacctgcctcaacgatggtgatacgtatgccgagcgccccaccagctgcggtcgtgctaccccgagcatccagattgccgtttgggacgacaacgacaagcccctgcccgctggccaaaagggtaacgtcatggtcaagggcgccgccaacctcaaggagtactggcgtaagcccgaggccaccgcggataccatgactgccgatggatggctgcgcaccggcgatgttggccacattgacgagggaggttacctgcatctgggcggccgcaccaaggagattatcatccgtggaggtgagaacatttcttgcgtcgccgtcgaggacggtgtctaccagcattctggtgtcgccgagtgcgccgccattcccgtcccccaccccactctcggcgaggaggtcggtatcgtcgtcttccccaagaacggtgccaagctgacgctcgaggagatcgttgccaagtgcgaggacctcgccaagttcgagtgccccacgcacttgtacatttggcccgagcagcttcctcgcggcgccacaggcaagatcgtcaagcgtgatatccgtcagatcatcgaggacaacaagatcctctccgagcagcaaaagaatcccaagtccaagctctaa

SEQ ID NO: 93 - protein, 602 aa, Schizochytrium sp.
MPALTKEQEAAIDAALHAPGTLLELREEVIAYEENHAPHHKGVKYQVYPNGPQTLVDLFSFPKATGNLDNPFLIYEDKRYTFREADEEASALGSALINDFGVKTLDRVCIVSKNRPEYAIGVMASTSVGATCVPMNSWWKTKELEYGLDNSGTKIVLCDLDRYKLLVPILDKLTNLEKVILFDDANAGSVEPHPKLLMYKDVVSKRRGDAMPPLTAGKDDNALIMYTSGTTGHPKGVVLTHRSICHAITCAVAHSIRQKMMAAAKAGKTFTPEEVDPKHFAVLLNVPLFHATGLHSVFFLSFVIGRKMVMMDKWNIEQALQLIERERVTNFTGVPTMVLDMMNHPNFKKYDTSSLEAVGGGGAAPPSTMVKDVQSNFKSAAPLQGFGMTETNALTCLNDGDTYAERPTSCGRATPSIQIAVWDDNDKPLPAGQKGNVMVKGAANLKEYWRKPEATADTMTADGWLRTGDVGHIDEGGYLHLGGRTKEIIIRGGENISCVAVEDGVYQHSGVAECAAIPVPHPTLGEEVGIVVFPKNGAKLTLEEIVAKCEDLAKFECPTHLYIWPEQLPRGATGKIVKRDIRQIIEDNKILSEQQKNPKSKL

SEQ ID NO: 94 - DNA, 1923 bp, Schizochytrium sp.
atgcggcgaacgagcttcgcactcgcgagcaggcgcctgcggctgcaagagagactcaggctgggcgcgagaagcgcgacccagcggatgcaaagcacggacgcgcgattttaccgagcaagcgctgcgttttcgtcccaggccagcttccccgacgacctcggcacgacctacctcgtcggggaccagcggctcgcacacgccaaagggccgaccggactcacgctgtacgagcgcaccattgatgagcatttccgggcggcagtcgaggctcgaccggacaagcaagcagctgtcgtctgtgacggcgcagaccatgtcgacgcccgacactcatacgcgtctctcgacgccaaggtggacgatctagctcgcggactcttgcgactcggcgtcgagcgcggagaccgcgtcggcgtgtggatgccaaacaatgaggcatggcttttgacgcagcttgcgacggcgcgcatcggagccatccttgtctgtattaatccgaattacaggcttcgcgagctgacgcacgctctcaacctcgtcgaactcagcgtgctcatcatgaaccctcacgtttcgcgctcaaactacattgaaatgcttcacactctcgttccctccttgcgcgaaaggacgcaaagcacgtgccgggaccccgtacaaagtgacaaagtgcctcaccttcgccacgttgtcctggcagaggcagacggctccgacggcgaggacacctttatccgcttcgaggaccttctcgaaaaggacggagctgcggccgttcctacgggccagggccttttgcaacccgacgacccaattaacattcagttcacaagtggaaccacaggagctcctaagggagctctgctgtcgagccgcaatattgtcaacaatggtaactttgtgggcgcctgcatccgtcttacgccagacgacattatcaatgtccccgtgcccttgtaccactgctttggagtcgtcatgggcaacttggcgtccatttcgcatggcgcttctgtggtgtatccggcgcgtgtattctccgcgagcaaaacgctcagtgtggtcgagtcggagcgctgtactgcgctttacggagtgcctaccatgttttctgccatgcttgcgtaccagcaagaggccaaacacgacgtttcgacgctgcggacgggcattatggcaggaagcaactgtccgcgtgaaatgatgcgtcgggttgttgccgagttgaacatgaccgacacctgcattggctacggtcagaccgagtcttctcccgtgagtttcatgtcgcgcatcgtcgatgacgaggatcaccgctgcgagaccgtgggtcgcatcactccgcacatagaagccaaggttgtggatgaggatggagagactcttccggttggtgttccgggtgagctttacgtgagaggctatcacatctttaagggctacataaatgctccggagcagaccaaggctaccttgacggacgatggctggctgcgtacgggcgacctcgttgacttggaccgcgatggttacctacgcgtagatggccgcctcaaggacgtgattattcgaggcggcgagaatatcgccccgcgcgaatgcgaagagctcattctcgagctccccggcgttcttaccgtggccgtcgtgggtgtgcccgacgaggtctttggcgagcaagtctgcgcagtggtggtgccgaacatggacacatccgaaggcaaggcgctcgatggcgatgctgtgcgcgattttgtccgggctgagctctctcatcaaaaggtgccaaagttcgtcctttttcgccactcctttgacgaattcatgactgtcactggcaagctgcgaaagtttcaagtgcgagactgggcgaccaaggagacatctgcgcagaaggaagctgctgccaaagctgcttaa

SEQ ID NO: 95 - protein, 640 aa, Schizochytrium sp.
MRRTSFALASRRLRLQERLRLGARSATQRMQSTDARFYRASAAFSSQASFPDDLGTTYLVGDQRLAHAKGPTGLTLYERTIDEHFRAAVEARPDKQAAVVCDGADHVDARHSYASLDAKVDDLARGLLRLGVERGDRVGVWMPNNEAWLLTQLATARIGAILVCINPNYRLRELTHALNLVELSVLIMNPHVSRSNYIEMLHTLVPSLRERTQSTCRDPVQSDKVPHLRHVVLAEADGSDGEDTFIRFEDLLEKDGAAAVPTGQGLLQPDDPINIQFTSGTTGAPKGALLSSRNIVNNGNFVGACIRLTPDDIINVPVPLYHCFGVVMGNLASISHGASVVYPARVFSASKTLSVVESERCTALYGVPTMFSAMLAYQQEAKHDVSTLRTGIMAGSNCPREMMRRVVAELNMTDTCIGYGQTESSPVSFMSRIVDDEDHRCETVGRITPHIEAKVVDEDGETLPVGVPGELYVRGYHIFKGYINAPEQTKATLTDDGWLRTGDLVDLDRDGYLRVDGRLKDVIIRGGENIAPRECEELILELPGVLTVAVVGVPDEVFGEQVCAVVVPNMDTSEGKALDGDAVRDFVRAELSHQKVPKFVLFRHSFDEFMTVTGKLRKFQVRDWATKETSAQKEAAAKAA

SEQ ID NO: 96 - DNA, 1893 bp, Schizochytrium sp.
atggatgcagaaaaggtcatcaaggcgggcgccgccgcgggcgcagcgtacctgggatggaagtatctcgacgagaagcacggcatcagccacgacctggagctggcgcggcgcctgctcaagctcaagaaagagatcaacgagcgcaacacgaaacgcgtctttaatgtgaccaacatgtggtacgaggcgtacgccaagaacccgaaaaagccggcgctcctctacctcgacgaggtcgtcacgtaccaggacatggaggaccgctcaaaccaggtggccaactggctcctgagcaaggggctcaagcgcggcgacaccgtggcccttctcatggagaaccgtcccgagttcgtcatctcgtggctcggcatgaccaagatcggcgtcaaggtcgcgctcatcaacacgagcatcaaacagaagcctctcttgcattgcctgaaaatctcggggtgcaaaatcgttctctttggaagcgagctcgcggagcccatcctcgacatcaaggacgagctcgccgacctcggcatcgagcttgccgccgagggcgcgcgtgaagcctctcccgactggatcgaggtcgtcaacccggaaatcgaggcctcgcccaagaccgcgacctcgcccaagcttcgcgaaggcatcggtatgcaggacgtctttggcttcatttacacctcgggcaccacgggtctgcccaaggcggctgtcattcttcaccaaaaaatgtttagctttggcgccctcatgaccaacgccttccagtgcactcaggacgatattgtctacacctgccttccgctcttccacagcgcgggcggcggtctcggcatcggcatcatgctctacaccggagccaccgtggtcatcaagcgcaagttcagcgtcacggacttttggagcgattgcgtcaagtacaagtgcactgtcgtacagtacattggtgaactctgccggtacctcgtcatggccgagtcgcggcccgaggagacccagcacaaggtccgccttgccatcggcaacggcctgcggcccgagatctgggccgagtttcaggagcgcttccagattccgcaaattggcgagttctatggcgccaccgagggcaatggcgccctcgtacagcactgcaccaagcccgaagaccgcggtgccgtcgggcgcatgggttcgctgctcatgcgcgttacgggcgtcaagtttgctcgcttcgatgtcctcgaggaggcaccggtgcgcggcgctgacggcttttgcatcgaatgtgacgtcgacgagcctggcgagctcctttttcctattcgcgacaacgaccccagctctgcctttgccggctacaacgaccccaaggccacagcaaagaagatcatcacggacgcctttaccaagggcgacaagtactttcgcaccggcgacttgctcagtcgtgatgcccgcggccgcatctactttcgcgaccgcatcggcgacacctttcgctgtaagggcgaaaacgtttccaccagcgaggtcgccgaagtcctttctacctatccgggtatcgaggagctcaacatctatggcgttcagatccccaacaatgaagatggccgctttccctgtgctgctcttacgcccaaggatagcgacctttccaacgttgatctcaaaggattttacgagcacgccaagaagaatcttccgagttactcgatcccgatgttcattcgcgtacagccggtcatgcctgtgactgccacgatgaagcatcaaaaggtgcagcttcgcaaggaaggcatggacattcacgtcatcaaggaccctatgtactggctccatgacgtaaagaaggagtatgatcccttgacggaggaggactacgcgcgcatcatcggacaacgcgcgcgtctt

SEQ ID NO: 97 - protein, 631 aa, Schizochytrium sp.
MDAEKVIKAGAAAGAAYLGWKYLDEKHGISHDLELARRLLKLKKEINERNTKRVFNVTNMWYEAYAKNPKKPALLYLDEVVTYQDMEDRSNQVANWLLSKGLKRGDTVALLMENRPEFVISWLGMTKIGVKVALINTSIKQKPLLHCLKISGCKIVLFGSELAEPILDIKDELADLGIELAAEGAREASPDWIEVVNPEIEASPKTATSPKLREGIGMQDVFGFIYTSGTTGLPKAAVILHQKMFSFGALMTNAFQCTQDDIVYTCLPLFHSAGGGLGIGIMLYTGATVVIKRKFSVTDFWSDCVKYKCTVVQYIGELCRYLVMAESRPEETQHKVRLAIGNGLRPEIWAEFQERFQIPQIGEFYGATEGNGALVQHCTKPEDRGAVGRMGSLLMRVTGVKFARFDVLEEAPVRGADGFCIECDVDEPGELLFPIRDNDPSSAFAGYNDPKATAKKIITDAFTKGDKYFRTGDLLSRDARGRIYFRDRIGDTFRCKGENVSTSEVAEVLSTYPGIEELNIYGVQIPNNEDGRFPCAALTPKDSDLSNVDLKGFYEHAKKNLPSYSIPMFIRVQPVMPVTATMKHQKVQLRKEGMDIHVIKDPMYWLHDVKKEYDPLTEEDYARIIGQRARL

SEQ ID NO: 98 - DNA, 2950 bp, Schizochytrium sp.
atgcgatgcggacgcatctctacagcctcctcagcgctagccggcctttggaccatcttccatgcaaacaaactgctgcgcttgcttcagcctgctgcagctgcacgaggccggcgcggaccgctcgtctcagttgttctcgagctcggacttcctcttccttctttctgcctgcctgctgccattcttacgtgcgtacgcatagtatactactttggcaacaactgcaagtgcagcaaagcacaatgccgttctgtacagaacgggaacgctcggcgccgacctcgactcggactcggacgccgagagcttcaagttcaaccgcagtgcggttgcggtggccgatgaagaggaggccgagagcctcaccgagagcaggacggagagggaagcggtccggaggggctgcactgggcaagcaagctgggctaacaggaagagctgagcagagccaagctacgctgagcgccgctcgggcagcatgccatccatggcttcaaggtggtgaggctgggccggcaaagcccgaactcgagagacagctcgcgagcgcgtgcgtcccctgggcaggccgagaagaccgcagcggagggcaaggatcgaggtatcgtcggagaccgggaggaccgggagcgcgcgatgggcagcggaggcaaggatgacgccggatcgggcgccagggcagcagcagcagccaagaaggacaaaccccttgcgacggttgaggtgctggattctgggcggcctgacctgggtctgggtccaatccggcgctgcgcgatgccgttcgggcctgagctctctgtcgaggggatgcgcacgctgtttgaggtttttcgacgctcggtcgataaacacggggaccgcccatgcctgggtagccgcccagttggcgaggatggcgaacctgggccgttctcgttcatgacctacaatgaagtgcacaagcacgccatggccttttcgcacggcctcgtgcaccttgacgtggtccacgccaacgacgagggccacaagctgcttggcttctttgcagtaaaccgccctggcgtcgtcatgtgtgagatcggcgccatggcccagcgcatcgtgcccgtgcccctgtacgcgaccctcggcaccgaggccgtcgagcacatcatcgaccagacccagatggaggtcattgtctgcacgagcagcgagctcgaggacacgctgtccaagtccgaggaggtcatgaagcagctcagcactatcattctcctcgatgaggaccttggcgacgcccgccttgatgagctccgcaagatcggcgctgacgccgaggtcaaggtgtacacgattgccgatgtcgaggagcttggcgaggcgcatgaaggcccgcttgatctcccgagcggcgacgacctcgcggtactctgctacacgagcgggtccacgggaacacccaagggcgtcctcattacgcacagcagcatcatctcggcggtggccagtctgcgccgctttggtatcgatgtgcacgaagacgacgtgcacctttcatacttgccattggcgcatattttcgagcgcgcactcatgtacgccatgctgtacggcggcgcctccgtggggtttttccggggttcctccaaggctatcttggcagacctcaaggccctgcggcccaccattttccccacggtgccccgtctgctcaacaagatgcacgactcgatctggtccaaggtccgggagacgggcggcgccaagcaggtcatctttgagaatgcgctccaggccaagttggagaaccttcacggcgtgacgacgcgcgacaagctcaatgccctgctcgaggactcaaccgtgacctcgtggctgttccagcgcactgtcaaggacaaggtcgaggacctgcgcacgggccgcatcatccggcaaattgctgggggcagcgacgaggacgtggagcgcgccgggggtctccaacagtggctctttgaaaaggcgctgcgcgccaagtcgcaccaggagcccagcgtggactttagcagctccgagggggaggtgactgcgcgctccaagaagccgctttcggatcaagtctttgaccggatcgttttcgacgcgctcaagaagaagattggccttgaccgcacgcgcattattgctgtcggatcagcgcccattacaggcgaggttcttgactttttccgctgcatgctgggcattcccgtgctcaatgcctttggatcgaccgagagctcatgcgtgatttcccttacccacccggaagatctttcgagcggccacgtgggtattcctgcgccctgcaacgaggtacgtctcaccaatgtcgacgacatgggctacaaggccaccgacacggagcacaatggcgttccgtgcctgggacggggcgagatctgcttccggggcccgaacgccttcaaggggtactacaagatgaaggagaagacggaagagactctcaccaaggacggctggtgtctgacgggcgacattggtatgtggaccgaggatggaatgctcaagattattgaccgcaagaagaatcttttcaagctggcccaaggcgagtacgtggcgcctgaaaaggtcgagaacgcttactgccgcgccgatctgctcgagtccatgttcgtgtacggtgactctgaaaagtccaaccttgttgccatcattcaccctgacgcggacgtcgtctctgaggttggattgcagatggaggactcgaaggagctccacgaccgcatccaggatgagctcgaccagcaggctgacgccgcgggtctcaagggctttgagcgcgtgcgtgcttttcacattgaaaccacgccttttacggaggttgagggcatcactacggccacgcagaagatcaagcgtgcggcagccaaggagcactacgaggacgtcatcgagaagctctacaaggagatcgacgagtaaatagacaata

SEQ ID NO: 99 - protein, 766 aa, Schizochytrium sp.
MGSGGKDDAGSGARAAAAAKKDKPLATVEVLDSGRPDLGLGPIRRCAMPFGPELSVEGMRTLFEVFRRSVDKHGDRPCLGSRPVGEDGEPGPFSFMTYNEVHKHAMAFSHGLVHLDVVHANDEGHKLLGFFAVNRPGVVMCEIGAMAQRIVPVPLYATLGTEAVEHIIDQTQMEVIVCTSSELEDTLSKSEEVMKQLSTIILLDEDLGDARLDELRKIGADAEVKVYTIADVEELGEAHEGPLDLPSGDDLAVLCYTSGSTGTPKGVLITHSSIISAVASLRRFGIDVHEDDVHLSYLPLAHIFERALMYAMLYGGASVGFFRGSSKAILADLKALRPTIFPTVPRLLNKMHDSIWSKVRETGGAKQVIFENALQAKLENLHGVTTRDKLNALLEDSTVTSWLFQRTVKDKVEDLRTGRIIRQIAGGSDEDVERAGGLQQWLFEKALRAKSHQEPSVDFSSSEGEVTARSKKPLSDQVFDRIVFDALKKKIGLDRTRIIAVGSAPITGEVLDFFRCMLGIPVLNAFGSTESSCVISLTHPEDLSSGHVGIPAPCNEVRLTNVDDMGYKATDTEHNGVPCLGRGEICFRGPNAFKGYYKMKEKTEETLTKDGWCLTGDIGMWTEDGMLKIIDRKKNLFKLAQGEYVAPEKVENAYCRADLLESMFVYGDSEKSNLVAIIHPDADVVSEVGLQMEDSKELHDRIQDELDQQADAAGLKGFERVRAFHIETTPFTEVEGITTATQKIKRAAAKEHYEDVIEKLYKEIDE

SEQ ID NO: 100 - DNA, 5341 bp, Schizochytrium sp.
ttcggctcttcgaacacttcgtcatcttccaccaccgcgactgcaggaaataccgctggcagcagtggaggcagcctcttcgggtcttcgggcgggacaagcaccggtgggggcacatccggctctcttttcggcagcagcagcagtagcagcagcaacggtgcgaccgggacggccagctcgagcgccggggacaattctagcacgtctttattttctggcccatcaacgccgctgcagtctggatcctcagggcttggcagcaatgcaggtaccactgcccctcgcaagaagtcgagcaggcgcaactctcgccgcaagtaaagaaaaaggtttttaccattatataccactacacatttgttccttcgactctcatgtttctacatttcgctcacatgtcagcttggttactcgctccattttccatcttgctgacgacagcgacgcccactcttgctgccacgcacactacactacctggcagtcggcactggtacggcgagcctccactccatccagctcgactcctccctcacccgaaccgcaacgcgtatggtctccgaggccgtcgtccgtcgcagcatcttcgccagtcaagatcgccctcgccaaccatgcgcatcctctgcgcatttccgcgctcgctgccgttatccgaggcgagctcgcgagtcccaaccgttcgttgttgacgcccccctctgccagagagcagaagaagctcacgggcctccctcgatcgatcgatctcttaaccgcgacgagggagccgccctgccgccagagggcctcgagaagccccccggccgcggcggttggcggcggagatcggtatcttcctcgcagaaagtagcgcatccgttcatggcgaactgtaaagtacgcatacgtctacgcgcgggcggctgcggctgcgaaagtaagaggactggagtgcacacgagccgcgagctgcgaaagctcggcctggccttgcctggtcctgctttcaagttctttcctctcctcgcatttcaagttcgcgcaggataggataggatccaaactgacagacaaaccgagacagacatgcgtataaacagacacagacagcgtctccctcgtctctcgggcggcagatcgcgatcgagggagagcgaggccccgcgaggctgcacgaggcgcgcgaccgcgactcgccgcggcaggagcgcggcagcggcggcgcgcggcgcggggaggaggcgcggagcgaggcggcggcgaggcagggcgaggcagggcaaggccccgctcgcatcgcgtcgcatcgcgccgcaccgcccgcggcacgtcgtcatcgaggggcgcgcgacgacgccgttggcgccggaggacgcgcagacgcagacgcaaagcgcgacgcggcgcgcggacagcagcgcagagcaaggcggaaagcgcgcgagagcggcgcagcgggcagcggcgaggcgaggcgaggtccggctcgggcgcgggcgcgggcgcgagaccgggagaaggagaagcgcgaggctcaagaagccgcgagatcagcgattcctctcctaacctctttctttcctcctcggacttgagcggcagaagcgcagctcggacgcagagcgcagcgcagcgccgcgcagcgccgcgcagcgacacggcagaggcgacggcgggcgggcgggcgggcgggcgggcgggcagacgcgcgcaagctctcggacagtctcggtcgctcgcgagccccagggcggagggcgtggacccgtgctccgcggaggaaggaagtaaaaaaaaagggcagaacagcatggagcggcctcaggcgcaggcctcgcccgcacggtccgaggcgcggcggcgacgcggcgacaggtccaaggggttcgccgacgaggatggagagaccagcgtgaacaccccgaacgggatgcagacaccgtacagcacgtcgatgggctccgtctcgagctactcgtcgtctggcgactacgccatgtccgaagcggagggctccgaagtggaccctgccgatgacaggatgggcgactcaatcggatcgaaaccaagctcctcgtccgtgaccggacgccggcgactcacgcaagaagagcgcgactactttttgcgtcttgaaaaggaatggcgcgaggaggacgcatgggctgaccaacccgggtcctggtactcaatgctggcctggatgccggtcctcattggcctgcgcgtcttcaacgtgctgctttccatcgccttttggcctgtctcctttgtggcgcgggtcttcttcggcaaaaagattcacacggtcagtttctgggacgttccgctttcccgccgtaaacaaactgccgtggtgctcttgttcgtcatgctcctgcccatggtcgtcgtggtgtactcgtggacgctcgttctgcttctcttcccgctcacgacctttcccacactgtgctacatggtgtggatcatttacgtggacaagagtcccgaaacaggctcgcgccgaccctttttgcgctattggaagatgtggcgccatttcgcgaactatttcccgcttcgactcattcgcaccacgccgctcgactcccgtcgcaagtacgtcttttgctaccatccgcacggaatcatctcgctcggtgcctttggcaactttgcgacggactcgaccggattctcgcgcaaattccccggtatcgatttgcgcgtgctcacgcttgcgctcaacttttactgcccccttttgcgcgagtttctgctttacctgggcctttgcagcgccgcaaagaagtcctgcaaccaaattttgcagcgcgggcctggatccgccatcatgctcgtcgttggcggcgccgccgagtctctcgactcccagccaggcacctatcgattgacgctcggccgaaaggggttcgtgcgcgttgcccttgacaatggtgccgatctagtgccggtgcttgcctttggcgagaatgacgtatttgacaccgtgtacctcccaccgaactcgtgggcacgaaacgtgcaagagtttgtgcgcaagaagcttggtttcgccacaccaattttcagtggccgcggtatcttccagtacaacatggggctcatgcctcaccgccgtcccattattgtcgttgttggaaaacccatcaaaatgcccaaaattcccgatgagctcaagggccgcgcgctttccaccacggccgagggcgttgccctcgttgacaagtaccacgaaaagtatgtcaaggcgcttcgcgagctctggaacttgtacaaggagcgctgggccgtgcaccgtcaaggttcgctgctcattcaaaagtaaaaaacctaatgaacaacccaagcaacttgcttcttttcttttcttttcttttcattttcggccttgctgtttgattgtgttgcgcagatgtctgtgtgaatgcaaacaagaaaaggtcaaaagtttcaagaagcaaaaaaaaccgaagaaatgaatgaatgaccaaaaagttttcaataaatgcgtatgacacgaggcaacgtgcgtgcgcagggtcttatttcttactactgttgttgttgttgttgttgttgtcgttgttgttgtttgtggagagcaactacgttgcaaagtcatattgtgtcgcggatgtggtgccatgtctgtttctctgtctcttttgtctgtatgtctacttgtcgtcgccttcttcgtccgaagcggattctgcgtcctcacgttcagcctcttcagcagcttctttgagcgcagccgcagcgtcgagatcatgcacatactctggaagtctgaaaatgtgcagcgtgttacggcctccagactttcgttcccagcgacccaagcggtgctcctgaccacagcccgcaaggagaacgcgacccgaagcgccaaaggccagcgcgtttacgtatccgggcactggcagactcatcagcgagggagccttgatccgacgcacagtcgtgtccacattccaaagcttgacgtacccgtccgcggcgcccgaagctgcaatatctgcgttgggcatagcagccacggagcaaatccacgagtcgccatgcgcgcggcgaacaatggagcttggcttcttcttcgctgtgctccacagcgcgagagtgccttcctgcgaaccactgacaaagtgcgtctcgtcggccatggcaatcgtgtcgattgacgacttgtgcacaccttgcaacacgagctgcgactcctcggggaatttccaaaagcgcacggaacggtccatggagcacgtgactgcgcgctccctatacaagcagtcaatgccaagaatcggggcctggtggccaaaaagcgactctatataagccatctcgtccacgttccatgcgcggacactgcggtcaaaagacgaagagtacaaggtgtgcttgccattcaaaaaggtaaggcctgagacggcgtcacgatggccggaaaagctgtcgaccagcgtgttcgatcgtgcatcccaaatatgaatcaccttgtccttgccgccgctcgcaaggtacctgccgtcagtgctgaccgcaaccgctaagatctcgtcgtgatgacctttgatgctcgaagcagcgatttgcttggtggcaggccgccctggaaaccgcgtgaccctttttccagtctccacatcccagcgcacgattgaacaatcctttgacccagtgtatgccacgtcctccgcgcctgtcagtgcaatgcacgtcacagacagacgatgcgttcgaggacacttatggtagctaatatcctcttgcttgagagccgcggccacaggtcgtcgcagtcggccttcggcgcggagaagatcgtggtgaagtttttgcgttacagggtctaacccgttgttaagtttggccgtgtcatcatcgtcgtcctcatcggagcccgagccgtcctcatcggagcccgtctcgcctgcgcgtcgttgcgaggcctgcaccttggcaagaatttctcgtgcaacacgaagtcgtttttctgctggggtctctgcatgttcctgagcatcggcaagcgtatcctcttgtgaattgcgacgatcatctacatcggattcctcatcgttgctgtcgagatcccagtcgacgttgagttttgcttcgcggcgggggcgcttcgtcccgtttgcctgtcgatcacatcgagagcattagttcgtcagtcgatcacctcctcattttatccaatcattccccagcatcatgtagaacaaaaaaagagggccaatctcgttgagcaatgggctgttcaaagtcatgcctcagttggcgatcaagcctaggttcggacagtctcaccttctcccgagagagaatcggaaacgaggaattc

SEQ ID NO: 101 - protein, 506 aa, Schizochytrium sp.
MERPQAQASPARSEARRRRGDRSKGFADEDGETSVNTPNGMQTPYSTSMGSVSSYSSSGDYAMSEAEGSEVDPADDRMGDSIGSKPSSSSVTGRRRLTQEERDYFLRLEKEWREEDAWADQPGSWYSMLAWMPVLIGLRVFNVLLSIAFWPVSFVARVFFGKKIHTVSFWDVPLSRRKQTAVVLLFVMLLPMVVVVYSWTLVLLLFPLTTFPTLCYMVWIIYVDKSPETGSRRPFLRYWKMWRHFANYFPLRLIRTTPLDSRRKYVFCYHPHGIISLGAFGNFATDSTGFSRKFPGIDLRVLTLALNFYCPLLREFLLYLGLCSAAKKSCNQILQRGPGSAIMLVVGGAAESLDSQPGTYRLTLGRKGFVRVALDNGADLVPVLAFGENDVFDTVYLPPNSWARNVQEFVRKKLGFATPIFSGRGIFQYNMGLMPHRRPIIVVVGKPIKMPKIPDELKGRALSTTAEGVALVDKYHEKYVKALRELWNLYKERWAVHRQGSLLIQK

SEQ ID NO: 102 - DNA, 1478 bp, Schizochytrium sp.
tgagggtagctaagcgacaatcgtggagtataagacctgatgtcatgatgatgtgacgaacaacgaacgtaaaaacgcagcacgaggcgcaagaagggacacctgcggcaaccaagtaggaacggcagacaggagattgcgctcctgtgccacgggctgccagctacaaacgcactcgcagcagcgacggcagagcaaacacgagtgacccacggacctctcttcatgcgtcgacgtgggggccaagatgagcacggcgcgagtcaagagcgtgaaactcacgagaacgacgacgacactgtagcgtcagagatagctcctttccagcgtgtggacgcgaatatggacgcgtggacgcgactgaaaactgccattgcgctcgtgacgctggtccctgtgaggatcgctctcttgacaacgctgctcggaacgtacggcttggcgctcgcagcgagtgcacgttttggcattccgcagcgctacaagctcgctgtgacccgccacgtgacgcgctggaccctatggatccttggtttttatcatattgaagtcgagggcgatgcacaaggcttgcaagaacgaccgcgtgtgattgttgcaaatcacatttcgtatcttgagattttgtactttatgtcgacagcgcattgcccttcgttcgtcatgaaaaagacctgtttaaaagtccccctcgttggctacgtcgccatggagcttggaggtctcttggtagaccgcgagggtggcggtccgagcgcttcggaggcaatcttctcgagggtgaagagtcctcgcaaagacgagaaacagccactgcttgtgtttcctgaaggaacgacttcaaatgggacgtgtcttttgcagttcaaaacaggagcttttcgcccgggcgtcccggttctccctgtggttctcgagttccccattgatgcttctcgcggagatttttcgccagcatatgaatcggtgcacacgccgacacaccttttacgcatgcttgcgcagtggcgacaccgcttgcgcgtgcgctatcttccactcttcgagcccaatgagatggagaaagctgatgcggcgctttttgcgcgcaatgttcgaaaggagatggcaagcgcgcttcatgtgcctacggtcgagcaaacctacagcgataagctcgcatatcatgcagagctcatgcctcactacaagcgagctggtcctggtgcgctttatctctatgtgcgtccggacatcctaccacatgcacgcaacacagtgtcatcatgaacgtattttggttaacggaagtatgcacatgcatgggagagaggaaagtatgctcaaagatgcacttgcacaccatttgtaggtaacccgattcgaagaggggaaaagggttatataaaatgaaagaggattcatctaacaatctagcatcatttgttctccttgacatgcaccctccgagaggaagaaaacctttcacttgggcacta

SEQ ID NO: 103 - DNA, 927 bp, Schizochytrium sp.
atggacgcgtggacgcgactgaaaactgccattgcgctcgtgacgctggtccctgtgaggatcgctctcttgacaacgctgctcggaacgtacggcttggcgctcgcagcgagtgcacgttttggcattccgcagcgctacaagctcgctgtgacccgccacgtgacgcgctggaccctatggatccttggtttttatcatattgaagtcgagggcgatgcacaaggcttgcaagaacgaccgcgtgtgattgttgcaaatcacatttcgtatcttgagattttgtactttatgtcgacagcgcattgcccttcgttcgtcatgaaaaagacctgtttaaaagtccccctcgttggctacgtcgccatggagcttggaggtctcttggtagaccgcgagggtggcggtccgagcgcttcggaggcaatcttctcgagggtgaagagtcctcgcaaagacgagaaacagccactgcttgtgtttcctgaaggaacgacttcaaatgggacgtgtcttttgcagttcaaaacaggagcttttcgcccgggcgtcccggttctccctgtggttctcgagttccccattgatgcttctcgcggagatttttcgccagcatatgaatcggtgcacacgccgacacaccttttacgcatgcttgcgcagtggcgacaccgcttgcgcgtgcgctatcttccactcttcgagcccaatgagatggagaaagctgatgcggcgctttttgcgcgcaatgttcgaaaggagatggcaagcgcgcttcatgtgcctacggtcgagcaaacctacagcgataagctcgcatatcatgcagagctcatgcctcactacaagcgagctggtcctggtgcgctttatctctatgtgcgtccggacatcctaccacatgcacgcaacacagtgtcatcatga

SEQ ID NO: 104 - protein, 308 aa, Schizochytrium sp.
MDAWTRLKTAIALVTLVPVRIALLTTLLGTYGLALAASARFGIPQRYKLAVTRHVTRWTLWILGFYHIEVEGDAQGLQERPRVIVANHISYLEILYFMSTAHCPSFVMKKTCLKVPLVGYVAMELGGLLVDREGGGPSASEAIFSRVKSPRKDEKQPLLVFPEGTTSNGTCLLQFKTGAFRPGVPVLPVVLEFPIDASRGDFSPAYESVHTPTHLLRMLAQWRHRLRVRYLPLFEPNEMEKADAALFARNVRKEMASALHVPTVEQTYSDKLAYHAELMPHYKRAGPGALYLYVRPDILPHARNTVSS

SEQ ID NO: 105 - DNA, 2111 bp, Schizochytrium sp.
cccacgcatccgagacggacgaccgaccgaccgaccgtgccggcagcggagcaggcgcacggcatcgcgcgcgaggcctcgcggggcgaaggactgactgagagagagagagtcagacaggcagacaggcagacagagagaccctaggcgcagaacccgaacggggagagggaccgcgaccgcaagacgggagaggcccgacgcggctcgacgtggcgtggcctgcgtaggagtgggcgggcgagctcggccggctggcgttgttgttgctgtcgctgtcgttgtcgtcgtcggtgctgccgtcgtcgttgttgtggttattgacgcggttgttgggtgggagaaaaagagaacaccacaccatgtgggcgccacagacggtcgtggagctgatgcgcagcaagctgggcggcgcggagaccgacgcgacagtgagcatgcccaagtcgaaaagcgccgcgaagtcgaccacggcgagcgtgatctcgcagttctcgcagtatgtggccgcaggcagcgccaccatggcgcgcgaggaaaccgagaaaaaggcgaacccattccagaccatggagcacatcaacgtccgcgagtggatcaaactcgtcgtcggcgcgctcatcgtcgcgccactgcgcttcctcatcattctcctcgtcatcggcatcggcacgatcttcatgatgctcaccgtcgcaggggcggacatctccaagccgctctccccgcgaagaggctttgcgcagcaaatcatcaccgccatctgcggctacctcatctgcgcctgcatgggtgtctaccgcatccgcaccaagggcacgcacgcgtccgccgaggagtgcaagatgatcatcgccgccccgcactcaaccgtcatggacgccgtcatcctcgcctacgcttgccgcggaccctctactgtgggcaaaattgaaatctccaagacctttctcggacccttcatgaacgccttgcaaaccatctacgtcgaccgttccgacaagttcaaccgctccagcgtggcagcgcagatccgcgcgcgtgtgggcgccgcctcgccctggcgtaggcaactcatgatcttccccgaaggcacctgcaccaaccggaccagcctcatctcttttcgccgcggtgctttcgagccttgtgcacctgtgcagccagtcgtgctccattggtcgtacaccaactttgacccgacctggtgcgccggcgcgccctcgcgcaccctcatcgccctccgtacgctctcgcagttcttccacgaggtcactgttgagtttctgcccgtgtacaagccctcggaagaggaacgcgcggattccgccctgtacagcgagaatgtgcgcaagcttatggctgtctcgctcggcatcccgacctcggaccactcgtacgaggacatgtttctcgcccaaatcgccgccaaaaacaagctcaagcctagcgctgtgctcccctttacatacgcctccctccggagcaagcttccgcccgcagctgcctcgagcccgcgcctctttgagcgtgtgcggggcctgctcttgtgctttgccaaggctcctctcatgacaaaggagcgccctcgtctcgatcgtgcccagtttgatgtcgtgtctcctgtggcggccacatcgctcgacattaagatttcgcttacctggacccaggtcgctttggagagctccgtcgccggtgcgccttcgtcggccgataccttttccttttacgagtttgcactcgcccagctcaaggctgcatcatgggactagcgactctgctttggccaagttccttgcatgttagactctacaggcaacaaagacggacaatcacggcgcaggacgaccgcacgagctgtctttgccttttatatacacacacacttcacccactcacgacgagactgaacatcatctgacccttttctcacgcattcatttgcgcgagagcgcacacacacacatggacatgtgatggtgttggcctctttttctttcttttggcatatttgcccatgcacaaaaagacttttgccaccacctttacattgtattgtagttactacagttagccaaagtagcctagttgcaacttttccccaaaaa

SEQ ID NO: 106 - DNA, 1140 bp, Schizochytrium sp.
cgcttcctcatcattctcctcgtcatcggcatcggcacgatcttcatgatgctcaccgtcgcaggggcggacatctccaagccgctctccccgcgaagaggctttgcgcagcaaatcatcaccgccatctgcggctacctcatctgcgcctgcatgggtgtctaccgcatccgcaccaagggcacgcacgcgtccgccgaggagtgcaagatgatcatcgccgccccgcactcaaccgtcatggacgccgtcatcctcgcctacgcttgccgcggaccctctactgtgggcaaaattgaaatctccaagacctttctcggacccttcatgaacgccttgcaaaccatctacgtcgaccgttccgacaagttcaaccgctccagcgtggcagcgcagatccgcgcgcgtgtgggcgccgcctcgccctggcgtaggcaactcatgatcttccccgaaggcacctgcaccaaccggaccagcctcatctcttttcgccgcggtgctttcgagccttgtgcacctgtgcagccagtcgtgctccattggtcgtacaccaactttgacccgacctggtgcgccggcgcgccctcgcgcaccctcatcgccctccgtacgctctcgcagttcttccacgaggtcactgttgagtttctgcccgtgtacaagccctcggaagaggaacgcgcggattccgccctgtacagcgagaatgtgcgcaagcttatggctgtctcgctcggcatcccgacctcggaccactcgtacgaggacatgtttctcgcccaaatcgccgccaaaaacaagctcaagcctagcgctgtgctcccctttacatacgcctccctccggagcaagcttccgcccgcagctgcctcgagcccgcgcctctttgagcgtgtgcggggcctgctcttgtgctttgccaaggctcctctcatgacaaaggagcgccctcgtctcgatcgtgcccagtttgatgtcgtgtctcctgtggcggccacatcgctcgacattaagatttcgcttacctggacccaggtcgctttggagagctccgtcgccggtgcgccttcgtcggccgataccttttccttttacgagtttgcactcgcccagctcaaggctgcatcatgggactag

SEQ ID NO: 107 - protein, 379 aa, Schizochytrium sp.
RFLIILLVIGIGTIFMMLTVAGADISKPLSPRRGFAQQIITAICGYLICACMGVYRIRTKGTHASAEECKMIIAAPHSTVMDAVILAYACRGPSTVGKIEISKTFLGPFMNALQTIYVDRSDKFNRSSVAAQIRARVGAASPWRRQLMIFPEGTCTNRTSLISFRRGAFEPCAPVQPVVLHWSYTNFDPTWCAGAPSRTLIALRTLSQFFHEVTVEFLPVYKPSEEERADSALYSENVRKLMAVSLGIPTSDHSYEDMFLAQIAAKNKLKPSAVLPFTYASLRSKLPPAAASSPRLFERVRGLLLCFAKAPLMTKERPRLDRAQFDVVSPVAATSLDIKISLTWTQVALESSVAGAPSSADTFSFYEFALAQLKAASWD

SEQ ID NO: 108 - DNA, 1861 bp, Schizochytrium sp.
atggcacgctagacagcgtagcgcacagacggcagacgataccaccgcgcgcatacgcacacacacacagacgcgcgcacgtgcgcgcccctgcgtctctttgttagtcgacgcgcgcgcgcgcgcgcacgttggcagacaagcaaacaagaaggtgagtgagctaaccagcaagcaagcaagcaagcatggcgaccgagcagccgtctttgcggcgactctccgctaaagagacgcgacgcatcgaacgccgcctctccacaacacgcaggagacgcaggtcgcacctcgaactcaaagaggtcaatccatttcagacggatgaggccatggacgcacaagaatgggtcctcttcgtgaccggcctcgtcgtgcttgcgccgttccgcattctcatctttctcgtcaccattcccgtcgccactggactcgtcctgctctccgtcattggatgcgacgtcaacgagccactcccagcatctcgcgctcgcattcaggcacatattgtttacgccacggctcgcatcctcctctcctgctttggtgtctacaccgtcgagacggttggcaagcttgcgcctgcaagcaaggcccgcgtcgccgtcgttgggcctcactccactccctttgacgctctcctcgcagccgcattcatggacgcccccagctttgttgcaaaagctgatctcacagagacctttgtcggacccgttctcaaggccatgcagaccattctcgtcgaccgcgaaaatatttccagcaggcacctcgctgcggaggccatcctacagcgcgccgatcgcacaggaacttggcgccgacgtcttgccgtttaccccgaaggcacgtgcacgaatcgaaccagtctcattcagttcagacgtggcgcctttgagcccctcgcacccgtacagcctgcagttctccagtggaacgtcggggcctttgaccccgcatggaccgtcggatccccccgacgtggactcattgttctccgctgccttgctcgactccagcttcacgtgaccgtacaatttctgcccgtcatggagcccctaaaaaatgaggacgccgctgcattttgcgaccgcgtgcgcagcgccatggccgacgcgctcggcgtccccaccaccgagtacacctatcctgatctctttcttgcaaagattgccgcaaagcgcaaagtcaagcccgcaatcgtactcccatggcccttcgtcgatgtccagcgcgcctttcctgacgttcctggcatttttgaaatcacaagagccctcttgcttcgctacctcgcagctcctggcgtacaagccaacaatggacgcatggaccactcggcattcaaggctgtcgctgtaaaggcggctcgtgatgccggaatcgagggtgagcctcctacctgggatcaggtcgcgcgtgaaacccacaccgacaagaccgtctcctttacagacttccttcaagctcatctcgagtgcctcgtttccaatccaacttcctcatcttcataacgagccattttctttccatctgggatctcacatcgcgcaccaagaaaaccttgacggacaacactgtgtccttttttaaacgaacttgctccaagaccatcccaaaagtctcgttttcatgctcatcgtgacgtgctttattgtttctcaattttgggtctcatctcagcccgcacacgaaacccatacggacaacaccgtctctctttcttcgtatatactccaagctcatctcgacgtcctcacaaggggacgtgaatcttcctcctcatgaggaaagaagatggccttgtagcacaacattgaataacatacgaacgtattttcacgcttcccctagaaaaaaaaaa

SEQ ID NO: 109 - DNA, 1323 bp, Schizochytrium sp.
atggcgaccgagcagccgtctttgcggcgactctccgctaaagagacgcgacgcatcgaacgccgcctctccacaacacgcaggagacgcaggtcgcacctcgaactcaaagaggtcaatccatttcagacggatgaggccatggacgcacaagaatgggtcctcttcgtgaccggcctcgtcgtgcttgcgccgttccgcattctcatctttctcgtcaccattcccgtcgccactggactcgtcctgctctccgtcattggatgcgacgtcaacgagccactcccagcatctcgcgctcgcattcaggcacatattgtttacgccacggctcgcatcctcctctcctgctttggtgtctacaccgtcgagacggttggcaagcttgcgcctgcaagcaaggcccgcgtcgccgtcgttgggcctcactccactccctttgacgctctcctcgcagccgcattcatggacgcccccagctttgttgcaaaagctgatctcacagagacctttgtcggacccgttctcaaggccatgcagaccattctcgtcgaccgcgaaaatatttccagcaggcacctcgctgcggaggccatcctacagcgcgccgatcgcacaggaacttggcgccgacgtcttgccgtttaccccgaaggcacgtgcacgaatcgaaccagtctcattcagttcagacgtggcgcctttgagcccctcgcacccgtacagcctgcagttctccagtggaacgtcggggcctttgaccccgcatggaccgtcggatccccccgacgtggactcattgttctccgctgccttgctcgactccagcttcacgtgaccgtacaatttctgcccgtcatggagcccctaaaaaatgaggacgccgctgcattttgcgaccgcgtgcgcagcgccatggccgacgcgctcggcgtccccaccaccgagtacacctatcctgatctctttcttgcaaagattgccgcaaagcgcaaagtcaagcccgcaatcgtactcccatggcccttcgtcgatgtccagcgcgcctttcctgacgttcctggcatttttgaaatcacaagagccctcttgcttcgctacctcgcagctcctggcgtacaagccaacaatggacgcatggaccactcggcattcaaggctgtcgctgtaaaggcggctcgtgatgccggaatcgagggtgagcctcctacctgggatcaggtcgcgcgtgaaacccacaccgacaagaccgtctcctttacagacttccttcaagctcatctcgagtgcctcgtttccaatccaacttcctcatcttcataa

SEQ ID NO: 110 - protein, 440 aa, Schizochytrium sp.
MATEQPSLRRLSAKETRRIERRLSTTRRRRRSHLELKEVNPFQTDEAMDAQEWVLFVTGLVVLAPFRILIFLVTIPVATGLVLLSVIGCDVNEPLPASRARIQAHIVYATARILLSCFGVYTVETVGKLAPASKARVAVVGPHSTPFDALLAAAFMDAPSFVAKADLTETFVGPVLKAMQTILVDRENISSRHLAAEAILQRADRTGTWRRRLAVYPEGTCTNRTSLIQFRRGAFEPLAPVQPAVLQWNVGAFDPAWTVGSPRRGLIVLRCLARLQLHVTVQFLPVMEPLKNEDAAAFCDRVRSAMADALGVPTTEYTYPDLFLAKIAAKRKVKPAIVLPWPFVDVQRAFPDVPGIFEITRALLLRYLAAPGVQANNGRMDHSAFKAVAVKAARDAGIEGEPPTWDQVARETHTDKTVSFTDFLQAHLECLVSNPTSSSS

SEQ ID NO: 111 - DNA, 794 bp, Schizochytrium sp.
catgtggcctgtgcggattttgtgcagactcttcatcttttgctttggtgtgtactggatttctgtcaagggtaaaaaggcgagtcatgctgaagcagcggtggccgtggtggccccgcattccacatttctggacaccatgacgtactatgccgtttatggccggtggtcgggtttgggtaaaaaggaagtgaccaagactccgttttttggcacgattttccgcggtctgcaaatgattgcggtggaccgcgagaatccggagggtcgcaaggccgcgctcgacgagtttgtgcggcgcgcacaagataacaaagggtggcctcagcttgttgtctttccagaaggtacttgcaccaatcggcgtgccctcatccaattcaagcgcgggcccttcgtccccggcgttcccattcagcctgtcgtgatgcgctggccatattatttctttgacccggcatggacctcgagcgggccgaaccggatcgcactcgtgttccgtctcatgacacaaatctttacgcgtgtcgaggtggagtttctccccgtgtacacgccgagcgacgaagaaaaggaagatccagagcttttcgcgcacaacgtacgcaataccatggcccaggcgcttggcgtgccaaccacggagcactcttacgaggatacgtttttgagcatggcggcaaagaaggccaagtttaatccggatgaaattgtcgatttcgagttcaccaaggtgaaaagagctcttggatattgacctcaaggaagcgcgccggcttctgaagcgattcggg

SEQ ID NO: 112 - DNA, 756 bp, Schizochytrium sp.
atgtggcctgtgcggattttgtgcagactcttcatcttttgctttggtgtgtactggatttctgtcaagggtaaaaaggcgagtcatgctgaagcagcggtggccgtggtggccccgcattccacatttctggacaccatgacgtactatgccgtttatggccggtggtcgggtttgggtaaaaaggaagtgaccaagactccgttttttggcacgattttccgcggtctgcaaatgattgcggtggaccgcgagaatccggagggtcgcaaggccgcgctcgacgagtttgtgcggcgcgcacaagataacaaagggtggcctcagcttgttgtctttccagaaggtacttgcaccaatcggcgtgccctcatccaattcaagcgcgggcccttcgtccccggcgttcccattcagcctgtcgtgatgcgctggccatattatttctttgacccggcatggacctcgagcgggccgaaccggatcgcactcgtgttccgtctcatgacacaaatctttacgcgtgtcgaggtggagtttctccccgtgtacacgccgagcgacgaagaaaaggaagatccagagcttttcgcgcacaacgtacgcaataccatggcccaggcgcttggcgtgccaaccacggagcactcttacgaggatacgtttttgagcatggcggcaaagaaggccaagtttaatccggatgaaattgtcgatttcgagttcaccaaggtgaaaagagctcttggatattga

SEQ ID NO: 113 - protein, 251 aa, Schizochytrium sp.
MWPVRILCRLFIFCFGVYWISVKGKKASHAEAAVAVVAPHSTFLDTMTYYAVYGRWSGLGKKEVTKTPFFGTIFRGLQMIAVDRENPEGRKAALDEFVRRAQDNKGWPQLVVFPEGTCTNRRALIQFKRGPFVPGVPIQPVVMRWPYYFFDPAWTSSGPNRIALVFRLMTQIFTRVEVEFLPVYTPSDEEKEDPELFAHNVRNTMAQALGVPTTEHSYEDTFLSMAAKKAKFNPDEIVDFEFTKVKRALGY

SEQ ID NO: 114 - DNA, 817 bp, Crypthecodinium cohnii
cactccaacgtacgacagcttcctcatattctttccaacatgtcgaacgatgctggaaagactgcagggcccctgacgaagcccacacgcagctacttggagtcgacagcggtcgagcgactggcaggatggctgtcggcttccatcttttccatcgtctactttgcggcaccgatctacttgacaggcacagctcttcttctggcacgggctccccgctcgaagttcacctggggtttggctgcgcccgtctgcctcgcagcgcttttgccctgcgacctcagcgcgcgcgtcggcccatcgatcttcaggacttggttcatgaagcaaattgtcaagtacttcaagtatgaggaatatcttgagttcacggacaaggatattgcggattcgcacaaagaggggaagcgcttcatcttcgctagccaccctcacggtgtcgtgagcttctgcggcatgtgcgctgctatcagcagtcatagtgctgttgatggcttctcaaccttcggcatcatggatctgccgacggcagtggcctcggtgatcaagatggttccattcttgaaaaacgttctcggcgttttcggcctcatcgatgccagcaagcaggtgctcgtgaagcgattgaagcgcgctggcggatccgtggtgatctacatcggaggcatggtggaactcttcatgtccagcccgaagcaggaggttgtcttcttgaagaagaggaagggcttcatcaggctcgctctgagcacaggtgccgatgttgtgccaatctacttgttcggcaacaccaccgtgctctcggttttgacttctg

SEQ ID NO: 115 - DNA, 850 bp, Crypthecodinium cohnii
ctgccagcgagatagcagatatcgtcgtattgtcgtgcaatcgagtgattgagtcaaatctagcgatatctgccttgttttttttgggggggcgccttgccaatcacccgcagcaaccatggctacacctgctgcttctccatcggtgaagaagtcggctccgaccacatttggcccagattgttgcgagggtccgacagtgctcatgcagattttggcagttctgctgatatccgcagtccccttgatcttcactctggcactcacaaacgggtctctgtttgctggcctccttgtggtcggtgtggtggcgctgccacggatcctttggcagcctggagggaatgaaggtttcgcttttcagttcgctttgggcctctactggaacttggtcaatgctgcgtgctttgggtcagtgttccttctcggagctgcttgctattttgctcccagaacagttctgcctttgatggcagtctacgtgctgtggatgcaggtcacacacttcgagttgaaggatgggcgagcgtgggcttcttttgccatgcgagagtggggtttccaggcattccgtcatttcatccaccttcaagttgttctaccagaggcgattttgcagaaaccggcagacgaacctctttttttcgctgtccatccccatggtgtggccagtgattttcgacttctgatggatggcatgcttcacaaggcaatgccctcacgtgaaattctcgttctggccgcatcggttctcttcaagctccccttggtgcgggagctctgcctgtggtctcgatgcatcgatgctagcaggccagtggcagagcgtgccttgcgccgaggtcatagt

SEQ ID NO: 116 - DNA, 663 bp, Crypthecodinium cohnii
caggtcagcggcgtgcaggcgccgatcctattcaggatacccatcctaagacaagttttgctctctttcggttgcacaatgccagccaccaaggacggaatgttcaaactcttccgaaaaaagatgcccttcggtataattgtcggggggagcgaggatgttgccatccaaatcaccggtcgcgagcgtatctacctcagacaccgcgctggttttttgaagtacgctctccagttcggttacaaagtcgtggtagcctacaacttcggtgagagcgatttgtacaggtccttcagcatcttagcgcctctgaacttgtggctcgtgaagcgatttggcttcgttttgccgctgttctacgggcagtggtggtgtccactcctcccacgtagcgacgttaccttgaacaccgtctatggggcggtcttggagcttcccagaatagatttccccagcgacgaagaggtcgcccattggcacggcaagtacatcgaggctgtgaccgacgtgttcgaaacacacaaggagcgattcggcttcgcttcgagaacgctggagattttgtaaggtctcgaagaacaaaaaatcctcgaccgttgaagagacactatcgtcgacgaaaggttcgaagatcaaatctcctcgattgttgaagacactatg

SEQ ID NO: 117 - DNA, 807 bp, Crypthecodinium cohnii
tcacactgaaagtcctcactgtttttgctgctcggtttcctgaacttgcgaactcctcactagttcgacttttcctcggggacaagtgtagcagcacggatcacgcgcgcgaagctccgctgtgtgtttttgcgtatataatcatcgattcaacagagtctctcctccgctccactcgactccactcaacttcacctgtctggtttggactttttcgttcgccccacttgactgggaatgactgtggagaagaacatggacagcatcaaaccagtcgatgatgccaagccacttgacgccaagcttggccacaacttgcatgcggcgagtcctgcagctgctaccgaaaggcctggctccagagggctcgaccgatgtgccttgatgctttacttgactttcccgctggcgaacatcgccgcggctggctgcctcaccttctgggctttgcttcgtggcggactcaaagtgcggtcgggcatgttggcctacctgtgctggatctgtttcttcgatcgaactccggagcggggaggctacaacttttgctggcgaaccggaatcacccagaaattgcgagcatccttcttctggaaatgggcagcaagatactttcctgtccggctacatgcagtggctcctcttcccccagatcaaggcccctacatttttgtgtgccacccacacggcatcttcggcatctcgccgatgactcactttgggaccgatgccacagacttctccaagatatttccgggaatccaagtgcaccttctcggccatagtgcgatcttcagaatccgttct

SEQ ID NO: 118 - DNA, 765 bp, Crypthecodinium cohnii
gtccttcttctgtgctcgactataaattacttgtttggcagctttcacccacccacccacccagccatctataatagcttttgatcttttccttcccatccatacacttctctacctgtgcttgtactgtgtacgtaatcacgcacgcacgcagtgcgtgcgaccaatggcttccaaatggatgctcttcagtggtggtgctgcagctgcagcattggcgctcttggaggctgcccaacatcgtttgccgacatcggtgcgcgctcggataatgctagcttcgttggccgcatatctgcccatgtatctcgatggaagcgagtaccgggctgcaccccggagaagtgagcgagcctcgagggttcttcggcagctgttcaagatgatggtggaccgtctcttcattgtcaaaaagccgattatcgaggcggccgaagagctaacatcctgcagccagtgcatcttgtcggttcatcctcatggggttctgtccctggatcatctcctgacagtcatcgcctatgaccccgagctggaaagggtgctgccccagggccgacgaagtgccctgagtgcaggtgtcctcttcaaaatccccatcttgcgagaggtgctgttgtggaccggttgcgttgatgccggggggcggacagtggattcgtgtctgaaggctggcttaagcctctctgtggtgcctgggggtgagcgcgaacagctcctagcccaacgtggcaacacagaaacgcttgtgctcaaaaacaggaa

SEQ ID NO: 119 - DNA, 782 bp, Crypthecodinium cohnii
ttcctgagctttcatcctctgccggacctctcggagaccctctgcgagtcctggttcaccatcgccctctacaagtacttctcctaccgcttcatctggagcgacgacgacaacgagaaggtgcgaacagctccggcctggttcggcgcatctcctccccacggtgtcctgccgctggccaacttgctgtgtattcccgcgataaacaactttgggttcagggagttcgttggggctcctgcctcggtcgtctttcgaactccctttctcagatacatgacgatgctgggctgcgtcgatgtcagcggcaagtcgatgaccaaggcggtcaatgctggtcagtgtgttggcctcgtgcccgacggcatcgcaggcatctttaagacgaaggaaaaggacgaagttgtcttcctcaagaacagaaaaggcctcgcaaagctggctctgaagacaggcaccccactgcttcctgcctacagcctgggcaacacagcagttttcggcgcctggttcgaccccttcggaatcatggaggctctgtccagaaaagctcagacatccgtcttcgtgttttggggtcgcttctacctcccgcttcccaggcgcgtcaacatcacgatggtctatggcaagcccatcattgttgagaaggtggaggatcccagcaccgagcaaatcgaccagctgcatgcggagtacctccaagagctggaggccttgttcaacaggcacaaggcaagtgtttgggtggggtcacaagaacattcgcttcgtctgagcat

SEQ ID NO: 120 - DNA, 793 bp, Crypthecodinium cohnii
cgtgcttgaagctcttgtctgtgtgtgtaatcaatgtatctttatcttcccggtgcagctccagctagctgcactgccccctccaattgatctggcggtggccctgagctgccgtcttgcatgccgacgactcgattttcctctgccaaagcctgggtttcaaagcaagcgatggccgtcacgtcagcgctctgcagtggcgtcggcgcagggctcttgatccacacagctgtcgtggcctatctgtacccactcttctttgcgccagtgctgctgttggttccctcccgcagaacgagggcgatgttcagatcgtattgtcagttctggcaggacatgtggatggcttcttcttgcgtggtgctggagtacgtgattggtgtccgcttgttcatacattccccaacagccttgaaggggttgcgtggcatcaaaaccatgtgcaacggccacgatgtgattctcatcaagaaccaccgcactcgaattgattggatgttcacctgggggctctgtctagctctcgaccgcctgggtagcctgaagatagtaatgaaagactccttgaagaaagttccctttttcggttgggcgatgcagcacttcggctttaccttcctttccaggaaaaaccgagatcatgacctggccaccctgaagtggtcgagctcctaccagagtcacgagcctggcagccgcatgacgatgctgatcttcccagagggaacggacctaagctcatcgaacctggaaaaaagcaaggctttcgccaccaaagcaggactgccggtct

SEQ ID NO: 121 - DNA, 744 bp, Crypthecodinium cohnii
cgagccggtcgtagacagatagacagatagatagacacgtagataggttttgtcgcatctttcgccaactctgcccggggggccaaaccttcttgctggggtttctgctctcttctcttcttgctggggcggcatggggaagcaccctcctgccaattatggcatcacggctgtgatcgccctcctcctctccgtgggccttatattggcgggcgtcattcagataatcactgcgctgctgacactccccgtactcgcctgcaagggccgcaacgccttccacagcatccagagcgcggtgtggcgcagcatcgtcaccttcctctccgtggggctcaacccgttctggtgcgcacgaatggtgtgggtgggtgacaaccctggccctccgaagggaaagatggggtcagtcttcttcatcaaccatcgctcaaatgctgacgcctggttcagcgcctggggaatcacccgaatgtgtcatgaagcgcggtacgtctacaagagtagcctaaagaagattcccttcttcggctggaacttgcagcttgctggcgacctcgctgtggagttcggagacaagtccaagatcgtagcgatgatggagaacgcgaaagaggcattgaggcagggctacaatgtggcggtctttccggaaggtacgagaagtcctagtggtatgttgcaggaattcaagcctggattcttcaagatcttgtgcagagcttggctgcccagcggtcccca

SEQ ID NO: 122 - DNA, 2361 bp, Artificial
  synthetic
gccgggctctttcacaaaggaataatgatcccacaaaagcttcacgtccttgggataccaatcgagatggtttcgtgatgggagagggagctggagttctacttttggaagaactcgagcatgctaagaaaagaggtgcaactatctacgcagagttcctcggtgggagtttcacatgtgatgcctatcacatgaccgagcctcaccctgatggggctggtgttattctctgtattgagagagcgttagctagtgctgggatttccaaggaacaaataaattacataaatgcacatgcaacctcaacgcatgctggagatattaaggaataccaagcccttgctcactgttttggccaaaatcctgagcttaaggtaaattccacaaaatctatgattggacacttgctgggagctgctggggccgtggaggctgttgcaactgtgcaggcgatacggaccggatgggttcatccaaatatcaacctcgagaatccagacatttaaatgtaagaatttcttatgttacattattacattcaacgttttatcttaattggctcttcatttgattgaaatttgacaattatttcttgttttttttttgtcacactctttttgggtttggggtggccgacgaattgtgggaaggtagaaagaggggaggactttgttatactccattagattttactgtttccgtttcaatttatgtgacatatttcctttttagtcggttccaaaagaaaatgtcagcattataaacaatttaattttgaaattacaattttgccattaataaaatgatttacaaccacaaaagtatctatgagcctgtttgggtgggcttataagcagcttattttaagtggcttataagtcaaaaagtgacaatttttgagaagttagaaaatcctaacttctcaaaaagtagcttttaagccacttatgacttataagtccaaaaatttttaagttaccaaacatatattaatgggtttataagcttataagccacttttaagctcacccaaacgggttctatgtctcactttagactacaaattttaaaagtcttcatttatttcttaatctccgtggcgagtaaaactataacacataaagtgaaacgtagggagtaagatggagtcataaactaatccaaatctatactctctccgttaatttgttttttagtttgatttggtacattaataaaacagatttttcgaaggttataaacacagacagatgtttcccagcgagctagcaaaattccaagatttctgtcgaaaattcgtgtgtttctagctagtacttgatgttatctttaaccttttagtaattttttgtccttttctttctatttttcatcttacaatgaattatgagcaagttccttaagtagcatcacacgtgagatgttttttatgatattgactaaatccaatctttaccattccttaactagtaaaatacaacacatgttaattgatacattgcttaacactgaggttagaaaattttagaaattagttgtccaaatgctttgaaattagaaatctttaatcccttatttttttttaaaatgttttttctcgctccaaagaaagagaaactgacatgaaagctcaaaagatcatgaatcttactaactttgtggaactaaatgtacatcagaatgtttctgacatgtgaaaatgaaagctcttaattttcttcttttatttattgagggtttttgcatgctatgcattcaatttgagtactttaaagcacctataaacacttacttacacttgccttggagtttatgttttagtgttttcttcacatcttttttggtcaatttgcagggatccgtctggattctcgaggttgatatttggatgaacccatccggtccgtatcgcctgcacagttgcaacagcctccacggccccagcagctcccagcaagtgtccaatcatagattttgtggaatttaccttaagctcaggattttggccaaaacagtgagcaagggcttggtattccttaatatctccagcatgcgttgaggttgcatgtgcatttatgtaatttatttgttccttggaaatcccagcactagctaacgctctctcaatacagagaataacaccagccccatcagggtgaggctcggtcatgtgataggcatcacatgtgaaactcccaccgaggaactctgcgtagatagttgcacctcttttcttagcatgctcgagttcttccaaaagtagaactccagctccctctcccatcacgaaaccatctcgattggtatcccaaggacgtgaagcttttgtgggatcattattcctttgtgaaagagcccggc

SEQ ID NO: 123 - DNA, 1380 bp, Artificial
  synthetic
cgatagaggcaaagagcaaagatgcatttgttcctccaaagccaaacgaattcgacattgctgtcctaactaacatctttttcgaagtggttaaaggcatgaacctcttgtcgaagatgggatctggattcttgacattcagcgtcataggagcaaccccgtgatgtatagcaaggatactgaaaatagcttccactgctccagctgctccaagaagatgaccagtagcccccttggtggaggagaatgccaaggtgcctgaagtagcatgttcagagaataccgtcttgatagctctcgcttccacggcatcgcctattggggttgatgttgcatgtgcgtttacataatcaatttggtttggacacagaccagactgtcttaaggcacgcgtcatggccaaaacagctccttttccatcttcaggaggttgagtaatatggtgtgcatcgcctgacatcccatatccacaaagctcagcataaatttttgctcctcgtctttttgcatgctcatattcctctaatactataacccctgaaccttcccctatcacaaaaccatcccggtcacaatcaaaaggccgtgaagcttcttgtggagaagaattgaatttagttgacaaagcccttgatctagagaatccagctacggacagagcatcaatgctagactcagttccaccagccaccataacatctgcatctccaaattgaatcatcctagtggcatcgcctatagaatgtgcaccagttgcgcaagctgtcacagcagcatgatttggcccctgaaatccatacttcatgctcacatgaccagatgccatgtttaccaatatttttggaatgaaaaacggactaagccgccgcagcctcttttcacaaatcagctgcgctgcctccacaatatcacatatacttccaattccaccaccaatagagactcctgttctctctttttcttcttcttcagttggtaaccactctgcatctctcaaagcttcatcggcagcacatacagcatatccgataaaattcgcaactgccttagagtttagccaaagggcttcatcaaattcaccagggtttgatccataaggcacaaaagcagcaactttagaagaaagctgatcaaaagtatataactttgtctcttcatcaaaagacttcatcttgagatcatcaagagtcaatcctctaatcccacattctccatcaattaaacgcctccacgttgtttcaacgcctctaccaagtggagtcaccatgcctagaccagtgacaacaacacggcgatgtgaatgataagaagaagaagtagagatgaagcggtttaagcggaggcgacttgcgctcaagtgtctacggagattagatgtcg

SEQ ID NO: 124 - DNA, 1052 bp, Artificial
  synthetic
gcgcgccgatttctaatgatgatctcgctaaaatagttgatactaatgatgaatggattgctactcgtactggtattcgcaaccgtcgagttgtctcaggcaaagatagcttggttggcttagcagtagaagcagcaaccaaagctcttgaaatggctgaggttgttcctgaagatattgacttagtcttgatgtgtacttccactcctgatgatctatttggtgctgctccacagattcaaaaggcacttggttgcacaaagaacccattggcttatgatatcacagctgcttgtagtggatttgttttgggtctagtttcagctgcttgtcatataaggggaggcggttttaagaacgttttagtgatcggagctgattctttgtctcggtttgttgattggacggatagagggacttgcattctatttggagatgctgctggtgctgtggttgttcaggcttgtgatattgaagatgatggtttgttcagttttgatgtgcacagcatttaaatgtgtatttggatccgctgtgcacatcaaaactgaacaaaccatcatcttcaatatcacaagcctgaacaaccacagcaccagcagcatctccaaatagaatgcaagtccctctatccgtccaatcaacaaaccgagacaaagaatcagctccgatcactaaaacgttcttaaaaccgcctccccttatatgacaagcagctgaaactagacccaaaacaaatccactacaagcagctgtgatatcataagccaatgggttctttgtgcaaccaagtgccttttgaatctgtggagcagcaccaaatagatcatcaggagtggaagtacacatcaagactaagtcaatatcttcaggaacaacctcagccatttcaagagctttggttgctgcttctactgctaagccaaccaagctatctttgcctgagacaactcgacggttgcgaataccagtacgagtagcaatccattcatcattagtatcaactattttagcgagatcatcattagaaatctctagagagttaattaaga

SEQ ID NO: 125 - DNA, 1208 bp, Artificial
  synthetic
cctccatcgcataattgctgatccccacgttaaaccggctccaaaaccggatgtcgctatggtatgtcctggtttaacttttccgcttctcactgcctcatcaagagccagcggaatcgaagcagcgctcgtgttaccataattagccaaattcgatatgactctctctggtgggaaatgcagccttgtagccacagagtctattattctctggttcgcctggtggaggaggagccagtcgatggcagaagcaggaagaccagctttttgtaaagcagattcaatagattgaggaacacatttgacagcaaagcgaaagacctcttttccattcatctgaatacaagaatatgaagattgttttggtggaaagtctccaaacaccgagccattggagcttgattcaccatcgttttgggattctttaacagaagcattcaaatgtcttcgaccatccccatcgctgtgcacatcaaaactgaacaaaccatcatcttcaatatcacaagcctgaacaaccacagcaccagcagcatctccaaatagaatgcaagtccctctatccgtccaatcaacaaaccgagacaaagaatcagctccgatcactaaaacgttcttaaaaccgcctccccttatatgacaagcagctgaaactagacccaaaacaaatccactacaagcagctgtgatatcataagccaatgggttctttgtgcaaccaagtgccttttgaatctgtggagcagcaccaaatagatcatcaggagtggaagtacacatcaagactaagtcaatatcttcaggaacaacctcagccatttcaagagctttggttgctgcttctactgctaagccaaccaagctatctttgcctgagacaactcgacggttgcgaataccagtacgagtagcaatccattcatcattagtatcaactattttagcgagatcatcattagaaatcagaagacttggaactgctgatccacatccaatcaatttgcagccactcggcactagcctgggtcgttgatattgagaaggagaagacgaagcatccttatcgacggagctgacgctagagcacaaaaccctcttagagaatcgattggaaacgcaaaacccagatccagaaactctaaccggaacatggattctgcttcgcaagttaggaattgaaggatgagtgaagaacccagatgcattag

What is claimed is:

1. An isolated nucleic acid molecule comprising a nucleic acid sequence encoding an acyl-CoA synthetase (ACoAS) that catalyzes the conversion of long chain Polyunsaturated Fatty Acids (PUFA) free fatty acids (FFA) to acyl-CoA, wherein the nucleic acid sequence encodes an acyl-CoA synthetase (ACoAS) that is at least 95% identical to an ACoAS having an amino acid sequence of SEQ ID NO:83.

2. The isolated nucleic acid molecule of claim 1, wherein the nucleic acid sequence encodes an acyl-CoA synthetase (ACoAS) having the amino acid sequence of SEQ ID NO:83.

3. The isolated nucleic acid molecule of claim 1, wherein the nucleic acid sequence comprises SEQ ID NO:82.

4. A recombinant nucleic acid molecule, comprising the nucleic acid molecule according to claim 1, operatively linked to an expression control sequence.

5. A recombinant host cell comprising the recombinant nucleic acid molecule of claim 4.

6. The recombinant host cell of claim 5, wherein the host cell is a microorganism.

7. The recombinant host cell of claim 5, wherein the host cell is a plant cell.

8. A genetically modified organism, wherein the organism has been genetically modified to express the isolated nucleic acid molecule of claim 1 and wherein the organism is a microorganism or a plant.

9. A genetically modified organism, wherein the organism has been genetically modified to express the isolated nucleic acid molecule of claim 3 and wherein the organism is a microorganism or a plant.

10. The genetically modified organism of claim 8, wherein the organism expresses a PUFA synthase and a phosphopantetheinyl transferase (PPTase).

11. The genetically modified organism of claim 10, wherein the organism has been genetically modified to express the synthase and the PPTase.

12. A process for transforming an organism to express PUFAs, comprising transforming an organism with nucleic acid molecules encoding a PUFA synthase, with a nucleic acid molecule encoding a phosphopantetheinyl transferase (PPTase), and with the nucleic acid molecule according to claim 1.

13. The process of claim 12, wherein the organism contains a genetic modification to delete or inactivate a fatty acid synthase (FAS) expressed by the organism.

14. The process of claim 12, wherein the organism contains a genetic modification to reduce competition for malonyl CoA with the PUFA synthase or to increase the level of malonyl CoA in the organism.

15. The process of claim 12, wherein the organism is a plant.

16. The process of claim 12, wherein the organism is a microorganism.

17. The recombinant host cell of claim 5, wherein the host cell is an animal cell.

18. The isolated nucleic acid molecule of claim 1, wherein the nucleic acid sequence encodes an acyl-CoA synthetase (ACoAS) that is at least 96% identical to an ACoAS having an amino acid sequence of SEQ ID NO:83.

19. The isolated nucleic acid molecule of claim 1, wherein the nucleic acid sequence encodes an acyl-CoA synthetase (ACoAS) that is at least 97% identical to an ACoAS having an amino acid sequence of SEQ ID NO:83.

20. The isolated nucleic acid molecule of claim 1, wherein the nucleic acid sequence encodes an acyl-CoA synthetase (ACoAS) that is at least 98% identical to an ACoAS having an amino acid sequence of SEQ ID NO:83.

21. The isolated nucleic acid molecule of claim 1, wherein the nucleic acid sequence encodes an acyl-CoA synthetase (ACoAS) that is at least 99% identical to an ACoAS having an amino acid sequence of SEQ ID NO:83.

* * * * *